United States Patent 12,497,611 (COMPOSITIONS AND METHODS FOR HIGH-THROUGHPUT ACTIVATION SCREENING TO BOOST T CELL EFFECTOR FUNCTION) - sequence listing, part 3

SEQ ID NO: 61047 - DNA, 15 bp, Artificial Sequence
  dgRNA
  Htr7
tcccccgtgcccgtc

SEQ ID NO: 61048 - DNA, 15 bp, Artificial Sequence
  dgRNA
  Htr7
cccccgtgcccgtcg

SEQ ID NO: 61049 - DNA, 15 bp, Artificial Sequence
  dgRNA
  Adcy3
ccagaagcccgacgc

SEQ ID NO: 61050 - DNA, 15 bp, Artificial Sequence
  dgRNA
  Adcy3
cccgacgcaggaaac

SEQ ID NO: 61051 - DNA, 15 bp, Artificial Sequence
  dgRNA
  Adcy3
ccgacgcaggaaacc

SEQ ID NO: 61052 - DNA, 15 bp, Artificial Sequence
  dgRNA
  Adcy3
aggaaaccgggtgtc

SEQ ID NO: 61053 - DNA, 15 bp, Artificial Sequence
  dgRNA
  Tpcn1
ttggttgcgcgagtg

SEQ ID NO: 61054 - DNA, 15 bp, Artificial Sequence
  dgRNA
  Tpcn1
gttgcgcgagtgagg

SEQ ID NO: 61055 - DNA, 15 bp, Artificial Sequence
  dgRNA
  Tpcn1
ttgcgcgagtgaggc

SEQ ID NO: 61056 - DNA, 15 bp, Artificial Sequence
  dgRNA
  Tpcn1
tgcgcgagtgaggcg

SEQ ID NO: 61057 - DNA, 15 bp, Artificial Sequence
  dgRNA
  Camsap2
gaacgtccaatccag

SEQ ID NO: 61058 - DNA, 15 bp, Artificial Sequence
  dgRNA
  Camsap2
aacgtccaatccagc

SEQ ID NO: 61059 - DNA, 15 bp, Artificial Sequence
  dgRNA
  Camsap2
tgctgattaatggat

SEQ ID NO: 61060 - DNA, 15 bp, Artificial Sequence
  dgRNA
  Camsap2
gctgattaatggata

SEQ ID NO: 61061 - DNA, 15 bp, Artificial Sequence
  dgRNA
  Pgm1
taggagactagagta

SEQ ID NO: 61062 - DNA, 15 bp, Artificial Sequence
  dgRNA
  Pgm1
cactccccaattgcc

SEQ ID NO: 61063 - DNA, 15 bp, Artificial Sequence
  dgRNA
  Pgm1
attgcctggccctcc

SEQ ID NO: 61064 - DNA, 15 bp, Artificial Sequence
  dgRNA
  Pgm1
cactaatggcgagtc

SEQ ID NO: 61065 - DNA, 15 bp, Artificial Sequence
  dgRNA
  Mgll
cgcgtccccacccag

SEQ ID NO: 61066 - DNA, 15 bp, Artificial Sequence
  dgRNA
  Mgll
gcgtccccacccagc

SEQ ID NO: 61067 - DNA, 15 bp, Artificial Sequence
  dgRNA
  Mgll
gcccccgccgccgag

SEQ ID NO: 61068 - DNA, 15 bp, Artificial Sequence
  dgRNA
  Mgll
ccgccgccgagcggc

SEQ ID NO: 61069 - DNA, 15 bp, Artificial Sequence
  dgRNA
  Gal3st4
ccagcggactggtaa

SEQ ID NO: 61070 - DNA, 15 bp, Artificial Sequence
  dgRNA
  Gal3st4
cagcggactggtaaa

SEQ ID NO: 61071 - DNA, 15 bp, Artificial Sequence
  dgRNA
  Gal3st4
agcggactggtaaag

SEQ ID NO: 61072 - DNA, 15 bp, Artificial Sequence
  dgRNA
  Gal3st4
actggtaaaggggca

SEQ ID NO: 61073 - DNA, 15 bp, Artificial Sequence
  dgRNA
  Pcyox1
cctcaacctgcgcct

SEQ ID NO: 61074 - DNA, 15 bp, Artificial Sequence
  dgRNA
  Pcyox1
ctgcgccttggatgt

SEQ ID NO: 61075 - DNA, 15 bp, Artificial Sequence
  dgRNA
  Pcyox1
accagagtgtacttc

SEQ ID NO: 61076 - DNA, 15 bp, Artificial Sequence
  dgRNA
  Pcyox1
ccagagtgtacttcg

SEQ ID NO: 61077 - DNA, 15 bp, Artificial Sequence
  dgRNA
  Papd4
cgcgctctccagtgt

SEQ ID NO: 61078 - DNA, 15 bp, Artificial Sequence
  dgRNA
  Papd4
tccagtgtcggctgc

SEQ ID NO: 61079 - DNA, 15 bp, Artificial Sequence
  dgRNA
  Papd4
gtcacgttgatcttc

SEQ ID NO: 61080 - DNA, 15 bp, Artificial Sequence
  dgRNA
  Papd4
tcacgttgatcttcc

SEQ ID NO: 61081 - DNA, 15 bp, Artificial Sequence
  dgRNA
  Fam229b
actgggtcattccgc

SEQ ID NO: 61082 - DNA, 15 bp, Artificial Sequence
  dgRNA
  Fam229b
ctgggtcattccgcc

SEQ ID NO: 61083 - DNA, 15 bp, Artificial Sequence
  dgRNA
  Fam229b
ggtcattccgccggg

SEQ ID NO: 61084 - DNA, 15 bp, Artificial Sequence
  dgRNA
  Fam229b
caacgacgccctacg

SEQ ID NO: 61085 - DNA, 15 bp, Artificial Sequence
  dgRNA
  Olfr921
tgttttaacctgttc

SEQ ID NO: 61086 - DNA, 15 bp, Artificial Sequence
  dgRNA
  Olfr921
gtatctttagttacc

SEQ ID NO: 61087 - DNA, 15 bp, Artificial Sequence
  dgRNA
  Lcn4
cacccctatgacaaa

SEQ ID NO: 61088 - DNA, 15 bp, Artificial Sequence
  dgRNA
  Lcn4
ggccatttgtcatag

SEQ ID NO: 61089 - DNA, 15 bp, Artificial Sequence
  dgRNA
  Frmd6
gcttcttccgctgct

SEQ ID NO: 61090 - DNA, 15 bp, Artificial Sequence
  dgRNA
  Frmd6
tctccgccttcaatt

SEQ ID NO: 61091 - DNA, 15 bp, Artificial Sequence
  dgRNA
  Frmd6
ctccgccttcaattt

SEQ ID NO: 61092 - DNA, 15 bp, Artificial Sequence
  dgRNA
  Frmd6
tccgccttcaatttg

SEQ ID NO: 61093 - DNA, 15 bp, Artificial Sequence
  dgRNA
  Rcor3
gcgctacggctcgac

SEQ ID NO: 61094 - DNA, 15 bp, Artificial Sequence
  dgRNA
  Rcor3
cgctacggctcgacc

SEQ ID NO: 61095 - DNA, 15 bp, Artificial Sequence
  dgRNA
  Rcor3
gctacggctcgaccg

SEQ ID NO: 61096 - DNA, 15 bp, Artificial Sequence
  dgRNA
  Rcor3
acggctcgaccgggg

SEQ ID NO: 61097 - DNA, 15 bp, Artificial Sequence
  dgRNA
  H2-Q10
ctgggccaggtcatt

SEQ ID NO: 61098 - DNA, 15 bp, Artificial Sequence
  dgRNA
  H2-Q10
tcattcggctcggct

SEQ ID NO: 61099 - DNA, 15 bp, Artificial Sequence
  dgRNA
  H2-Q10
ctcggacactgattg

SEQ ID NO: 61100 - DNA, 15 bp, Artificial Sequence
  dgRNA
  H2-Q10
ctgattgaggctatc

SEQ ID NO: 61101 - DNA, 15 bp, Artificial Sequence
  dgRNA
  Tgfb1i1
tatcccagcgggtcc

SEQ ID NO: 61102 - DNA, 15 bp, Artificial Sequence
  dgRNA
  Tgfb1i1
cccggcttccataca

SEQ ID NO: 61103 - DNA, 15 bp, Artificial Sequence
  dgRNA
  Tgfb1i1
gtcctccgcccccac

SEQ ID NO: 61104 - DNA, 15 bp, Artificial Sequence
  dgRNA
  Tgfb1i1
cgcccccaccggaca

SEQ ID NO: 61105 - DNA, 15 bp, Artificial Sequence
  dgRNA
  Dyrk4
atttcactcatacct

SEQ ID NO: 61106 - DNA, 15 bp, Artificial Sequence
  dgRNA
  Dyrk4
gggtgatccatgaat

SEQ ID NO: 61107 - DNA, 15 bp, Artificial Sequence
  dgRNA
  Dyrk4
gagaaaacgaggttg

SEQ ID NO: 61108 - DNA, 15 bp, Artificial Sequence
  dgRNA
  Dyrk4
ggcctatgcgaaaga

SEQ ID NO: 61109 - DNA, 15 bp, Artificial Sequence
  dgRNA
  Stpg2
cgctgaattgaacgc

SEQ ID NO: 61110 - DNA, 15 bp, Artificial Sequence
  dgRNA
  Stpg2
gaattgaacgctggc

SEQ ID NO: 61111 - DNA, 15 bp, Artificial Sequence
  dgRNA
  Stpg2
acgctggcgggctgg

SEQ ID NO: 61112 - DNA, 15 bp, Artificial Sequence
  dgRNA
  Stpg2
ggcgggcgggtcctc

SEQ ID NO: 61113 - DNA, 15 bp, Artificial Sequence
  dgRNA
  Nbea
gctcacctgtcggcc

SEQ ID NO: 61114 - DNA, 15 bp, Artificial Sequence
  dgRNA
  Nbea
cccggtcccagcgcg

SEQ ID NO: 61115 - DNA, 15 bp, Artificial Sequence
  dgRNA
  Nbea
ccggtcccagcgcgt

SEQ ID NO: 61116 - DNA, 15 bp, Artificial Sequence
  dgRNA
  Nbea
cggtcccagcgcgtg

SEQ ID NO: 61117 - DNA, 15 bp, Artificial Sequence
  dgRNA
  Gmppa
ttaagccttgtccta

SEQ ID NO: 61118 - DNA, 15 bp, Artificial Sequence
  dgRNA
  Gmppa
cctacggtgacttga

SEQ ID NO: 61119 - DNA, 15 bp, Artificial Sequence
  dgRNA
  Gmppa
ttgacggaacgcacc

SEQ ID NO: 61120 - DNA, 15 bp, Artificial Sequence
  dgRNA
  Gmppa
tccagtatgggctca

SEQ ID NO: 61121 - DNA, 15 bp, Artificial Sequence
  dgRNA
  C7
ctgataaaatgcatc

SEQ ID NO: 61122 - DNA, 15 bp, Artificial Sequence
  dgRNA
  C7
gtatatctgttaatt

SEQ ID NO: 61123 - DNA, 15 bp, Artificial Sequence
  dgRNA
  C7
ttgctgcaaccagct

SEQ ID NO: 61124 - DNA, 15 bp, Artificial Sequence
  dgRNA
  C7
ttcaccagactctcc

SEQ ID NO: 61125 - DNA, 15 bp, Artificial Sequence
  dgRNA
  Tmbim6
acttttcctactcca

SEQ ID NO: 61126 - DNA, 15 bp, Artificial Sequence
  dgRNA
  Tmbim6
gaaatggggcgtgtc

SEQ ID NO: 61127 - DNA, 15 bp, Artificial Sequence
  dgRNA
  Tmbim6
cgggcttcagaccca

SEQ ID NO: 61128 - DNA, 15 bp, Artificial Sequence
  dgRNA
  Ankrd11
ggcaaaccaccagat

SEQ ID NO: 61129 - DNA, 15 bp, Artificial Sequence
  dgRNA
  Ankrd11
tattatagttggtcc

SEQ ID NO: 61130 - DNA, 15 bp, Artificial Sequence
  dgRNA
  Ankrd11
taaagagctcctatc

SEQ ID NO: 61131 - DNA, 15 bp, Artificial Sequence
  dgRNA
  Ankrd11
cctctctagctggtc

SEQ ID NO: 61132 - DNA, 15 bp, Artificial Sequence
  dgRNA
  C1ql3
ctagtatgaccagct

SEQ ID NO: 61133 - DNA, 15 bp, Artificial Sequence
  dgRNA
  C1ql3
tagtatgaccagcta

SEQ ID NO: 61134 - DNA, 15 bp, Artificial Sequence
  dgRNA
  C1ql3
ggcgctgccatcgtc

SEQ ID NO: 61135 - DNA, 15 bp, Artificial Sequence
  dgRNA
  C1ql3
gcgctgccatcgtct

SEQ ID NO: 61136 - DNA, 15 bp, Artificial Sequence
  dgRNA
  Fam76b
cagccaaacgacgac

SEQ ID NO: 61137 - DNA, 15 bp, Artificial Sequence
  dgRNA
  Fam76b
aacgacgactggccg

SEQ ID NO: 61138 - DNA, 15 bp, Artificial Sequence
  dgRNA
  Fam76b
actggccgtggcttg

SEQ ID NO: 61139 - DNA, 15 bp, Artificial Sequence
  dgRNA
  Fam76b
ctggccgtggcttgt

SEQ ID NO: 61140 - DNA, 15 bp, Artificial Sequence
  dgRNA
  Tnnc1
gtccttcatagctcc

SEQ ID NO: 61141 - DNA, 15 bp, Artificial Sequence
  dgRNA
  Tnnc1
ggtggaggatattcc

SEQ ID NO: 61142 - DNA, 15 bp, Artificial Sequence
  dgRNA
  Tnnc1
tataagcccaagcag

SEQ ID NO: 61143 - DNA, 15 bp, Artificial Sequence
  dgRNA
  Tnnc1
ataagcccaagcaga

SEQ ID NO: 61144 - DNA, 15 bp, Artificial Sequence
  dgRNA
  Brd9
agccttctccgatgt

SEQ ID NO: 61145 - DNA, 15 bp, Artificial Sequence
  dgRNA
  Brd9
cttctccgatgtagg

SEQ ID NO: 61146 - DNA, 15 bp, Artificial Sequence
  dgRNA
  Brd9
taggaggatccacct

SEQ ID NO: 61147 - DNA, 15 bp, Artificial Sequence
  dgRNA
  Brd9
atccaccttggctaa

SEQ ID NO: 61148 - DNA, 15 bp, Artificial Sequence
  dgRNA
  Esrp1
accgctgccacgtcg

SEQ ID NO: 61149 - DNA, 15 bp, Artificial Sequence
  dgRNA
  Esrp1
cacgtcgtggtttga

SEQ ID NO: 61150 - DNA, 15 bp, Artificial Sequence
  dgRNA
  Esrp1
tggccgggcgccgcc

SEQ ID NO: 61151 - DNA, 15 bp, Artificial Sequence
  dgRNA
  Esrp1
cttacctgcaccacg

SEQ ID NO: 61152 - DNA, 15 bp, Artificial Sequence
  dgRNA
  Scn2a1
gagggctcacagcgc

SEQ ID NO: 61153 - DNA, 15 bp, Artificial Sequence
  dgRNA
  Scn2a1
cacgtgttatcttaa

SEQ ID NO: 61154 - DNA, 15 bp, Artificial Sequence
  dgRNA
  Scn2a1
tctctcacatccagt

SEQ ID NO: 61155 - DNA, 15 bp, Artificial Sequence
  dgRNA
  Scn2a1
aggggtggcaatcac

SEQ ID NO: 61156 - DNA, 15 bp, Artificial Sequence
  dgRNA
  Tmem9
caggagtctagattg

SEQ ID NO: 61157 - DNA, 15 bp, Artificial Sequence
  dgRNA
  Tmem9
gagtctagattgagg

SEQ ID NO: 61158 - DNA, 15 bp, Artificial Sequence
  dgRNA
  Tmem9
ggagcctttcggaac

SEQ ID NO: 61159 - DNA, 15 bp, Artificial Sequence
  dgRNA
  Tmem9
gagcctttcggaaca

SEQ ID NO: 61160 - DNA, 15 bp, Artificial Sequence
  dgRNA
  Pde9a
ggcgggccagcgccg

SEQ ID NO: 61161 - DNA, 15 bp, Artificial Sequence
  dgRNA
  Pde9a
gcgggccagcgccgt

SEQ ID NO: 61162 - DNA, 15 bp, Artificial Sequence
  dgRNA
  Pde9a
cagcgccgtgggagg

SEQ ID NO: 61163 - DNA, 15 bp, Artificial Sequence
  dgRNA
  Pde9a
agcgccgtgggagga

SEQ ID NO: 61164 - DNA, 15 bp, Artificial Sequence
  dgRNA
  Pofut1
aggccccggtagtgg

SEQ ID NO: 61165 - DNA, 15 bp, Artificial Sequence
  dgRNA
  Pofut1
ccccggtagtggcgg

SEQ ID NO: 61166 - DNA, 15 bp, Artificial Sequence
  dgRNA
  Pofut1
ggtagtggcggcggt

SEQ ID NO: 61167 - DNA, 15 bp, Artificial Sequence
  dgRNA
  Pofut1
gtagtggcggcggtc

SEQ ID NO: 61168 - DNA, 15 bp, Artificial Sequence
  dgRNA
  Ppfia2
agtcagatccagtcc

SEQ ID NO: 61169 - DNA, 15 bp, Artificial Sequence
  dgRNA
  Ppfia2
accatctctccgccc

SEQ ID NO: 61170 - DNA, 15 bp, Artificial Sequence
  dgRNA
  Ppfia2
catctctccgccccg

SEQ ID NO: 61171 - DNA, 15 bp, Artificial Sequence
  dgRNA
  Ppfia2
tgctgcacgcgaaag

SEQ ID NO: 61172 - DNA, 15 bp, Artificial Sequence
  dgRNA
  Prl2a1
aatcatcattgcaat

SEQ ID NO: 61173 - DNA, 15 bp, Artificial Sequence
  dgRNA
  Prl2a1
atcatcattgcaatt

SEQ ID NO: 61174 - DNA, 15 bp, Artificial Sequence
  dgRNA
  Prl2a1
ccccttagcaatata

SEQ ID NO: 61175 - DNA, 15 bp, Artificial Sequence
  dgRNA
  Prl2a1
caatatatggccttg

SEQ ID NO: 61176 - DNA, 15 bp, Artificial Sequence
  dgRNA
  Spink8
ggtttgctcttacgt

SEQ ID NO: 61177 - DNA, 15 bp, Artificial Sequence
  dgRNA
  Spink8
actcgtgtctgttgc

SEQ ID NO: 61178 - DNA, 15 bp, Artificial Sequence
  dgRNA
  Spink8
tcttagttccacagg

SEQ ID NO: 61179 - DNA, 15 bp, Artificial Sequence
  dgRNA
  Dnttip2
cccgcactagtccga

SEQ ID NO: 61180 - DNA, 15 bp, Artificial Sequence
  dgRNA
  Dnttip2
gcactagtccgatgg

SEQ ID NO: 61181 - DNA, 15 bp, Artificial Sequence
  dgRNA
  Dnttip2
gatggcggagaccgc

SEQ ID NO: 61182 - DNA, 15 bp, Artificial Sequence
  dgRNA
  Dnttip2
gattctcccgagccg

SEQ ID NO: 61183 - DNA, 15 bp, Artificial Sequence
  dgRNA
  Chil3
ctatcttgactgaac

SEQ ID NO: 61184 - DNA, 15 bp, Artificial Sequence
  dgRNA
  Chil3
tgaactggtgataaa

SEQ ID NO: 61185 - DNA, 15 bp, Artificial Sequence
  dgRNA
  Chil3
ccgggttatctatta

SEQ ID NO: 61186 - DNA, 15 bp, Artificial Sequence
  dgRNA
  Chil3
cgggttatctattaa

SEQ ID NO: 61187 - DNA, 15 bp, Artificial Sequence
  dgRNA
  Mlycd
ccaagagggcgagtc

SEQ ID NO: 61188 - DNA, 15 bp, Artificial Sequence
  dgRNA
  Mlycd
gcgagtcaggtgccc

SEQ ID NO: 61189 - DNA, 15 bp, Artificial Sequence
  dgRNA
  Mlycd
cgagtcaggtgcccc

SEQ ID NO: 61190 - DNA, 15 bp, Artificial Sequence
  dgRNA
  Mlycd
gtgccccggggctac

SEQ ID NO: 61191 - DNA, 15 bp, Artificial Sequence
  dgRNA
  Dda1
cgggccaatgacgcg

SEQ ID NO: 61192 - DNA, 15 bp, Artificial Sequence
  dgRNA
  Dda1
agcaccgcgcgtcat

SEQ ID NO: 61193 - DNA, 15 bp, Artificial Sequence
  dgRNA
  Pih1d3
gccatagaccctgaa

SEQ ID NO: 61194 - DNA, 15 bp, Artificial Sequence
  dgRNA
  Pih1d3
ccatagaccctgaac

SEQ ID NO: 61195 - DNA, 15 bp, Artificial Sequence
  dgRNA
  Pih1d3
ctgaacgggacgagc

SEQ ID NO: 61196 - DNA, 15 bp, Artificial Sequence
  dgRNA
  Pih1d3
tgaacgggacgagct

SEQ ID NO: 61197 - DNA, 15 bp, Artificial Sequence
  dgRNA
  Lrrn4cl
atccttccgcgttca

SEQ ID NO: 61198 - DNA, 15 bp, Artificial Sequence
  dgRNA
  Lrrn4cl
tggctggtatcagac

SEQ ID NO: 61199 - DNA, 15 bp, Artificial Sequence
  dgRNA
  Lrrn4cl
attatcggaggaggg

SEQ ID NO: 61200 - DNA, 15 bp, Artificial Sequence
  dgRNA
  Lrrn4cl
agtattatcggagga

SEQ ID NO: 61201 - DNA, 15 bp, Artificial Sequence
  dgRNA
  Olfr190
agtgattatccattg

SEQ ID NO: 61202 - DNA, 15 bp, Artificial Sequence
  dgRNA
  Zfp467
tagtgcaccctcccg

SEQ ID NO: 61203 - DNA, 15 bp, Artificial Sequence
  dgRNA
  Zfp467
gcaccctcccgcggc

SEQ ID NO: 61204 - DNA, 15 bp, Artificial Sequence
  dgRNA
  Zfp467
agtgttcccgcttcc

SEQ ID NO: 61205 - DNA, 15 bp, Artificial Sequence
  dgRNA
  Zfp467
gtgttcccgcttccc

SEQ ID NO: 61206 - DNA, 15 bp, Artificial Sequence
  dgRNA
  Fam161a
ggactcatggtatgt

SEQ ID NO: 61207 - DNA, 15 bp, Artificial Sequence
  dgRNA
  Fam161a
gactcatggtatgtt

SEQ ID NO: 61208 - DNA, 15 bp, Artificial Sequence
  dgRNA
  Olfr798
gatacaagttttgta

SEQ ID NO: 61209 - DNA, 15 bp, Artificial Sequence
  dgRNA
  Olfr798
atctggtgattgcct

SEQ ID NO: 61210 - DNA, 15 bp, Artificial Sequence
  dgRNA
  Olfr798
aaacacctatgcatc

SEQ ID NO: 61211 - DNA, 15 bp, Artificial Sequence
  dgRNA
  Olfr1200
tttcggctgtgcatg

SEQ ID NO: 61212 - DNA, 15 bp, Artificial Sequence
  dgRNA
  Olfr1200
tgtgggtaatatgag

SEQ ID NO: 61213 - DNA, 15 bp, Artificial Sequence
  dgRNA
  Olfr1200
ttacacgtaataaaa

SEQ ID NO: 61214 - DNA, 15 bp, Artificial Sequence
  dgRNA
  Ptprj
aaggtcctaacacac

SEQ ID NO: 61215 - DNA, 15 bp, Artificial Sequence
  dgRNA
  Ptprj
aggtcctaacacaca

SEQ ID NO: 61216 - DNA, 15 bp, Artificial Sequence
  dgRNA
  Ptprj
ggtcctaacacacag

SEQ ID NO: 61217 - DNA, 15 bp, Artificial Sequence
  dgRNA
  Ptprj
tgtcatcccggtgaa

SEQ ID NO: 61218 - DNA, 15 bp, Artificial Sequence
  dgRNA
  Prss39
agtgcttttgccccc

SEQ ID NO: 61219 - DNA, 15 bp, Artificial Sequence
  dgRNA
  Prss39
gcttttgcccccagg

SEQ ID NO: 61220 - DNA, 15 bp, Artificial Sequence
  dgRNA
  Prss39
aggtgcgtatgttta

SEQ ID NO: 61221 - DNA, 15 bp, Artificial Sequence
  dgRNA
  Prss39
gcataaggacaaccc

SEQ ID NO: 61222 - DNA, 15 bp, Artificial Sequence
  dgRNA
  Vangl1
gccctccgctgcagg

SEQ ID NO: 61223 - DNA, 15 bp, Artificial Sequence
  dgRNA
  Vangl1
ccctccgctgcaggt

SEQ ID NO: 61224 - DNA, 15 bp, Artificial Sequence
  dgRNA
  Vangl1
cgctgcaggtgggcc

SEQ ID NO: 61225 - DNA, 15 bp, Artificial Sequence
  dgRNA
  Vangl1
gccgggccggcagcg

SEQ ID NO: 61226 - DNA, 15 bp, Artificial Sequence
  dgRNA
  Acsl1
attgttcgttcttat

SEQ ID NO: 61227 - DNA, 15 bp, Artificial Sequence
  dgRNA
  Acsl1
ttgttcgttcttatt

SEQ ID NO: 61228 - DNA, 15 bp, Artificial Sequence
  dgRNA
  Acsl1
catgggtggagcggt

SEQ ID NO: 61229 - DNA, 15 bp, Artificial Sequence
  dgRNA
  Acsl1
gaacgaacaatggat

SEQ ID NO: 61230 - DNA, 15 bp, Artificial Sequence
  dgRNA
  Chchd7
tcctcccgctgcccg

SEQ ID NO: 61231 - DNA, 15 bp, Artificial Sequence
  dgRNA
  Chchd7
cctcccgctgcccgg

SEQ ID NO: 61232 - DNA, 15 bp, Artificial Sequence
  dgRNA
  Chchd7
cccgctgcccggggg

SEQ ID NO: 61233 - DNA, 15 bp, Artificial Sequence
  dgRNA
  Chchd7
gcgcgcctgtcaatc

SEQ ID NO: 61234 - DNA, 15 bp, Artificial Sequence
  dgRNA
  Dnmt3b
actcccgtgcgcgcc

SEQ ID NO: 61235 - DNA, 15 bp, Artificial Sequence
  dgRNA
  Dnmt3b
ctcgcctgagcgccg

SEQ ID NO: 61236 - DNA, 15 bp, Artificial Sequence
  dgRNA
  Dnmt3b
cgccgcggactagcc

SEQ ID NO: 61237 - DNA, 15 bp, Artificial Sequence
  dgRNA
  Dnmt3b
gccgcggactagccc

SEQ ID NO: 61238 - DNA, 15 bp, Artificial Sequence
  dgRNA
  Gripap1
caaggactttacgtg

SEQ ID NO: 61239 - DNA, 15 bp, Artificial Sequence
  dgRNA
  Gripap1
ggactttacgtgagg

SEQ ID NO: 61240 - DNA, 15 bp, Artificial Sequence
  dgRNA
  Gripap1
gactttacgtgaggc

SEQ ID NO: 61241 - DNA, 15 bp, Artificial Sequence
  dgRNA
  Gripap1
ggcgggattcccctt

SEQ ID NO: 61242 - DNA, 15 bp, Artificial Sequence
  dgRNA
  Ifna11
ccccctcaggcatgt

SEQ ID NO: 61243 - DNA, 15 bp, Artificial Sequence
  dgRNA
  Sema3a
attgctccccccaaa

SEQ ID NO: 61244 - DNA, 15 bp, Artificial Sequence
  dgRNA
  Sema3a
aaacaacgcttgcct

SEQ ID NO: 61245 - DNA, 15 bp, Artificial Sequence
  dgRNA
  Sema3a
aacaacgcttgcctc

SEQ ID NO: 61246 - DNA, 15 bp, Artificial Sequence
  dgRNA
  Sema3a
aacgcttgcctcggg

SEQ ID NO: 61247 - DNA, 15 bp, Artificial Sequence
  dgRNA
  Tex22
tcccatgcgaccatg

SEQ ID NO: 61248 - DNA, 15 bp, Artificial Sequence
  dgRNA
  Tex22
atgtggacgatttca

SEQ ID NO: 61249 - DNA, 15 bp, Artificial Sequence
  dgRNA
  Tex22
aaactgacggcgctc

SEQ ID NO: 61250 - DNA, 15 bp, Artificial Sequence
  dgRNA
  Tex22
atgcggcttgaacgc

SEQ ID NO: 61251 - DNA, 15 bp, Artificial Sequence
  dgRNA
  Olfr460
ggtaaggactgcaag

SEQ ID NO: 61252 - DNA, 15 bp, Artificial Sequence
  dgRNA
  Ninj2
cctggctgggattcg

SEQ ID NO: 61253 - DNA, 15 bp, Artificial Sequence
  dgRNA
  Ninj2
ctggctgggattcga

SEQ ID NO: 61254 - DNA, 15 bp, Artificial Sequence
  dgRNA
  Ninj2
tcaatatgccacatg

SEQ ID NO: 61255 - DNA, 15 bp, Artificial Sequence
  dgRNA
  Ninj2
aatatgccacatgcg

SEQ ID NO: 61256 - DNA, 15 bp, Artificial Sequence
  dgRNA
  Grip1
ccgaggagctttgtg

SEQ ID NO: 61257 - DNA, 15 bp, Artificial Sequence
  dgRNA
  Grip1
agctttgtgcggccg

SEQ ID NO: 61258 - DNA, 15 bp, Artificial Sequence
  dgRNA
  Grip1
tttgtgcggccgcgg

SEQ ID NO: 61259 - DNA, 15 bp, Artificial Sequence
  dgRNA
  Grip1
acctgctggcggcgg

SEQ ID NO: 61260 - DNA, 15 bp, Artificial Sequence
  dgRNA
  Kcnj6
aagggtgggcagcta

SEQ ID NO: 61261 - DNA, 15 bp, Artificial Sequence
  dgRNA
  Kcnj6
cggttctccagcgcg

SEQ ID NO: 61262 - DNA, 15 bp, Artificial Sequence
  dgRNA
  Kcnj6
cgtgcgctgacagcg

SEQ ID NO: 61263 - DNA, 15 bp, Artificial Sequence
  dgRNA
  Kcnj6
gcgcggctcagcccg

SEQ ID NO: 61264 - DNA, 15 bp, Artificial Sequence
  dgRNA
  Cpd
cgactaaagtcccta

SEQ ID NO: 61265 - DNA, 15 bp, Artificial Sequence
  dgRNA
  Cpd
tggagacacgcccag

SEQ ID NO: 61266 - DNA, 15 bp, Artificial Sequence
  dgRNA
  Cpd
aaatcgtccgcttta

SEQ ID NO: 61267 - DNA, 15 bp, Artificial Sequence
  dgRNA
  Cpd
attcaaggctacgat

SEQ ID NO: 61268 - DNA, 15 bp, Artificial Sequence
  dgRNA
  Oas1e
gctatctaggtgcag

SEQ ID NO: 61269 - DNA, 15 bp, Artificial Sequence
  dgRNA
  Trmt5
ctgctaagtaaatca

SEQ ID NO: 61270 - DNA, 15 bp, Artificial Sequence
  dgRNA
  Trmt5
taaccccaagcgccc

SEQ ID NO: 61271 - DNA, 15 bp, Artificial Sequence
  dgRNA
  Trmt5
agcgccccggctgag

SEQ ID NO: 61272 - DNA, 15 bp, Artificial Sequence
  dgRNA
  Trmt5
gagcggcttcagagg

SEQ ID NO: 61273 - DNA, 15 bp, Artificial Sequence
  dgRNA
  Aspn
ataattcatggcaac

SEQ ID NO: 61274 - DNA, 15 bp, Artificial Sequence
  dgRNA
  Aspn
gtctactggaagatt

SEQ ID NO: 61275 - DNA, 15 bp, Artificial Sequence
  dgRNA
  Aspn
actctagacgtctac

SEQ ID NO: 61276 - DNA, 15 bp, Artificial Sequence
  dgRNA
  Mug1
ggatggcgttggtaa

SEQ ID NO: 61277 - DNA, 15 bp, Artificial Sequence
  dgRNA
  Mug1
aaaacgcactgccca

SEQ ID NO: 61278 - DNA, 15 bp, Artificial Sequence
  dgRNA
  Allc
ggtaggatgggctta

SEQ ID NO: 61279 - DNA, 15 bp, Artificial Sequence
  dgRNA
  Allc
atgggcttacggccc

SEQ ID NO: 61280 - DNA, 15 bp, Artificial Sequence
  dgRNA
  Allc
tgggcttacggccct

SEQ ID NO: 61281 - DNA, 15 bp, Artificial Sequence
  dgRNA
  Allc
ggccctgggatcagt

SEQ ID NO: 61282 - DNA, 15 bp, Artificial Sequence
  dgRNA
  9330182O14Rik
tctacatcacctgat

SEQ ID NO: 61283 - DNA, 15 bp, Artificial Sequence
  dgRNA
  9330182O14Rik
aacgagagcctgggc

SEQ ID NO: 61284 - DNA, 15 bp, Artificial Sequence
  dgRNA
  9330182O14Rik
gacaaacgagagcct

SEQ ID NO: 61285 - DNA, 15 bp, Artificial Sequence
  dgRNA
  9330182O14Rik
agacaaacgagagcc

SEQ ID NO: 61286 - DNA, 15 bp, Artificial Sequence
  dgRNA
  Ube2u
taccccactggtgtc

SEQ ID NO: 61287 - DNA, 15 bp, Artificial Sequence
  dgRNA
  Ube2u
accccactggtgtcc

SEQ ID NO: 61288 - DNA, 15 bp, Artificial Sequence
  dgRNA
  Ube2u
tgtccgggtgcactg

SEQ ID NO: 61289 - DNA, 15 bp, Artificial Sequence
  dgRNA
  Ube2u
gtccgggtgcactga

SEQ ID NO: 61290 - DNA, 15 bp, Artificial Sequence
  dgRNA
  Med12
tccctcggcagtttc

SEQ ID NO: 61291 - DNA, 15 bp, Artificial Sequence
  dgRNA
  Med12
cccttctctcggcct

SEQ ID NO: 61292 - DNA, 15 bp, Artificial Sequence
  dgRNA
  Med12
ctctctaccgccgcc

SEQ ID NO: 61293 - DNA, 15 bp, Artificial Sequence
  dgRNA
  Med12
ccctgcaggcgcctc

SEQ ID NO: 61294 - DNA, 15 bp, Artificial Sequence
  dgRNA
  Thbd
tgcaggccacgcccg

SEQ ID NO: 61295 - DNA, 15 bp, Artificial Sequence
  dgRNA
  Thbd
gcaggccacgcccga

SEQ ID NO: 61296 - DNA, 15 bp, Artificial Sequence
  dgRNA
  Thbd
taactcatcgcgcag

SEQ ID NO: 61297 - DNA, 15 bp, Artificial Sequence
  dgRNA
  Thbd
cgcagaggtgatccc

SEQ ID NO: 61298 - DNA, 15 bp, Artificial Sequence
  dgRNA
  Me3
cccacctgctcgcag

SEQ ID NO: 61299 - DNA, 15 bp, Artificial Sequence
  dgRNA
  Me3
ccacctgctcgcagt

SEQ ID NO: 61300 - DNA, 15 bp, Artificial Sequence
  dgRNA
  Me3
agttaggcaggtaag

SEQ ID NO: 61301 - DNA, 15 bp, Artificial Sequence
  dgRNA
  Me3
caggtaagcggaaga

SEQ ID NO: 61302 - DNA, 15 bp, Artificial Sequence
  dgRNA
  Fxr2
gaagccctgacgcgc

SEQ ID NO: 61303 - DNA, 15 bp, Artificial Sequence
  dgRNA
  Fxr2
tgacgcgctggcgag

SEQ ID NO: 61304 - DNA, 15 bp, Artificial Sequence
  dgRNA
  Fxr2
gacgcgctggcgagc

SEQ ID NO: 61305 - DNA, 15 bp, Artificial Sequence
  dgRNA
  Fxr2
ctggcgagcgggagc

SEQ ID NO: 61306 - DNA, 15 bp, Artificial Sequence
  dgRNA
  1700080O16Rik
aatccatgttcgcac

SEQ ID NO: 61307 - DNA, 15 bp, Artificial Sequence
  dgRNA
  1700080O16Rik
gttcgcacaggcatc

SEQ ID NO: 61308 - DNA, 15 bp, Artificial Sequence
  dgRNA
  1700080O16Rik
ttcgcacaggcatcc

SEQ ID NO: 61309 - DNA, 15 bp, Artificial Sequence
  dgRNA
  1700080O16Rik
aggcatccgggaact

SEQ ID NO: 61310 - DNA, 15 bp, Artificial Sequence
  dgRNA
  Wdpcp
gaggcgcctgcctga

SEQ ID NO: 61311 - DNA, 15 bp, Artificial Sequence
  dgRNA
  Wdpcp
atggcgctcagcaat

SEQ ID NO: 61312 - DNA, 15 bp, Artificial Sequence
  dgRNA
  Wdpcp
cgctcagcaattggc

SEQ ID NO: 61313 - DNA, 15 bp, Artificial Sequence
  dgRNA
  Wdpcp
ggaggcgttaactcg

SEQ ID NO: 61314 - DNA, 15 bp, Artificial Sequence
  dgRNA
  Ubr4
ttttcaatcgtgcgc

SEQ ID NO: 61315 - DNA, 15 bp, Artificial Sequence
  dgRNA
  Ubr4
gcaggcgcactaccc

SEQ ID NO: 61316 - DNA, 15 bp, Artificial Sequence
  dgRNA
  Ubr4
caggcgcactaccct

SEQ ID NO: 61317 - DNA, 15 bp, Artificial Sequence
  dgRNA
  Ubr4
ttgttgggcgacccg

SEQ ID NO: 61318 - DNA, 15 bp, Artificial Sequence
  dgRNA
  Efcab2
gtcacaatcaggccc

SEQ ID NO: 61319 - DNA, 15 bp, Artificial Sequence
  dgRNA
  Efcab2
ggcccaggcgggttc

SEQ ID NO: 61320 - DNA, 15 bp, Artificial Sequence
  dgRNA
  Efcab2
ataaatgacgcccct

SEQ ID NO: 61321 - DNA, 15 bp, Artificial Sequence
  dgRNA
  Efcab2
taggcccaaagaacg

SEQ ID NO: 61322 - DNA, 15 bp, Artificial Sequence
  dgRNA
  Atg13
taaataggtcgtttg

SEQ ID NO: 61323 - DNA, 15 bp, Artificial Sequence
  dgRNA
  Atg13
ttcgtgtagaatgta

SEQ ID NO: 61324 - DNA, 15 bp, Artificial Sequence
  dgRNA
  Mrpl55
cccgcccacactctc

SEQ ID NO: 61325 - DNA, 15 bp, Artificial Sequence
  dgRNA
  Mrpl55
agcgacgccagaacc

SEQ ID NO: 61326 - DNA, 15 bp, Artificial Sequence
  dgRNA
  Mrpl55
ccccaccacgagagc

SEQ ID NO: 61327 - DNA, 15 bp, Artificial Sequence
  dgRNA
  Mrpl55
ccaaccacgcccacc

SEQ ID NO: 61328 - DNA, 15 bp, Artificial Sequence
  dgRNA
  Msx1
gcggaaaagctcccc

SEQ ID NO: 61329 - DNA, 15 bp, Artificial Sequence
  dgRNA
  Msx1
tctgtcccgcctgtg

SEQ ID NO: 61330 - DNA, 15 bp, Artificial Sequence
  dgRNA
  Msx1
ctgtcccgcctgtgc

SEQ ID NO: 61331 - DNA, 15 bp, Artificial Sequence
  dgRNA
  Msx1
ccgcctgtgcgggtc

SEQ ID NO: 61332 - DNA, 15 bp, Artificial Sequence
  dgRNA
  Ptgir
acggatactcagagc

SEQ ID NO: 61333 - DNA, 15 bp, Artificial Sequence
  dgRNA
  Ptgir
agggcgggccctagg

SEQ ID NO: 61334 - DNA, 15 bp, Artificial Sequence
  dgRNA
  Ptgir
gggcgggccctagga

SEQ ID NO: 61335 - DNA, 15 bp, Artificial Sequence
  dgRNA
  Ptgir
tccagaggccccctc

SEQ ID NO: 61336 - DNA, 15 bp, Artificial Sequence
  dgRNA
  Nabp2
gggaggattggtatc

SEQ ID NO: 61337 - DNA, 15 bp, Artificial Sequence
  dgRNA
  Nabp2
atctggggcgccccc

SEQ ID NO: 61338 - DNA, 15 bp, Artificial Sequence
  dgRNA
  Nabp2
aactaatacactgca

SEQ ID NO: 61339 - DNA, 15 bp, Artificial Sequence
  dgRNA
  Nabp2
aaactgcccccttcg

SEQ ID NO: 61340 - DNA, 15 bp, Artificial Sequence
  dgRNA
  Bccip
aggcaatcggcccca

SEQ ID NO: 61341 - DNA, 15 bp, Artificial Sequence
  dgRNA
  Bccip
caatcggccccaagg

SEQ ID NO: 61342 - DNA, 15 bp, Artificial Sequence
  dgRNA
  Bccip
agcagattagtccag

SEQ ID NO: 61343 - DNA, 15 bp, Artificial Sequence
  dgRNA
  Bccip
gcagattagtccagt

SEQ ID NO: 61344 - DNA, 15 bp, Artificial Sequence
  dgRNA
  Eml1
ttacaagccctgagc

SEQ ID NO: 61345 - DNA, 15 bp, Artificial Sequence
  dgRNA
  Eml1
gagaacacgcagacc

SEQ ID NO: 61346 - DNA, 15 bp, Artificial Sequence
  dgRNA
  Eml1
agaacacgcagacca

SEQ ID NO: 61347 - DNA, 15 bp, Artificial Sequence
  dgRNA
  Eml1
gaacacgcagaccag

SEQ ID NO: 61348 - DNA, 15 bp, Artificial Sequence
  dgRNA
  Vezt
ggtcgcgatgcatgc

SEQ ID NO: 61349 - DNA, 15 bp, Artificial Sequence
  dgRNA
  Vezt
gtcgcgatgcatgcc

SEQ ID NO: 61350 - DNA, 15 bp, Artificial Sequence
  dgRNA
  Vezt
ttttcagtgcccccg

SEQ ID NO: 61351 - DNA, 15 bp, Artificial Sequence
  dgRNA
  Vezt
cagtgcccccgaggt

SEQ ID NO: 61352 - DNA, 15 bp, Artificial Sequence
  dgRNA
  Prpsap2
agactgcgaggccag

SEQ ID NO: 61353 - DNA, 15 bp, Artificial Sequence
  dgRNA
  Prpsap2
gagactgcgaggcca

SEQ ID NO: 61354 - DNA, 15 bp, Artificial Sequence
  dgRNA
  Prpsap2
cgagactgcgaggcc

SEQ ID NO: 61355 - DNA, 15 bp, Artificial Sequence
  dgRNA
  Prpsap2
tctttcgagactgcg

SEQ ID NO: 61356 - DNA, 15 bp, Artificial Sequence
  dgRNA
  Vstm2l
acccccgctcccgcg

SEQ ID NO: 61357 - DNA, 15 bp, Artificial Sequence
  dgRNA
  Vstm2l
cccccgctcccgcgc

SEQ ID NO: 61358 - DNA, 15 bp, Artificial Sequence
  dgRNA
  Vstm2l
ccgctcccgcgcggg

SEQ ID NO: 61359 - DNA, 15 bp, Artificial Sequence
  dgRNA
  Vstm2l
tccctccgccgccgc

SEQ ID NO: 61360 - DNA, 15 bp, Artificial Sequence
  dgRNA
  Defb34
catgaatcagggcat

SEQ ID NO: 61361 - DNA, 15 bp, Artificial Sequence
  dgRNA
  Defb34
atgaatcagggcatg

SEQ ID NO: 61362 - DNA, 15 bp, Artificial Sequence
  dgRNA
  Defb34
acgcttcactgatca

SEQ ID NO: 61363 - DNA, 15 bp, Artificial Sequence
  dgRNA
  Defb34
agaagcgtataacgg

SEQ ID NO: 61364 - DNA, 15 bp, Artificial Sequence
  dgRNA
  Nup155
ttcccgtcccagaag

SEQ ID NO: 61365 - DNA, 15 bp, Artificial Sequence
  dgRNA
  Nup155
ggcgtcttccagtgc

SEQ ID NO: 61366 - DNA, 15 bp, Artificial Sequence
  dgRNA
  Nup155
gcgtcttccagtgcc

SEQ ID NO: 61367 - DNA, 15 bp, Artificial Sequence
  dgRNA
  Nup155
cgtcttccagtgccg

SEQ ID NO: 61368 - DNA, 15 bp, Artificial Sequence
  dgRNA
  Ppm1h
cccatcctcctcgcc

SEQ ID NO: 61369 - DNA, 15 bp, Artificial Sequence
  dgRNA
  Ppm1h
cgccaggtaccgacc

SEQ ID NO: 61370 - DNA, 15 bp, Artificial Sequence
  dgRNA
  Ppm1h
ctgaggtcacgatct

SEQ ID NO: 61371 - DNA, 15 bp, Artificial Sequence
  dgRNA
  Ppm1h
ctagctgtgctcggc

SEQ ID NO: 61372 - DNA, 15 bp, Artificial Sequence
  dgRNA
  Vsir
actaggagaaccgca

SEQ ID NO: 61373 - DNA, 15 bp, Artificial Sequence
  dgRNA
  Vsir
aaccgcaaggcaagc

SEQ ID NO: 61374 - DNA, 15 bp, Artificial Sequence
  dgRNA
  Vsir
accgcaaggcaagct

SEQ ID NO: 61375 - DNA, 15 bp, Artificial Sequence
  dgRNA
  Vsir
aagctgggttagact

SEQ ID NO: 61376 - DNA, 15 bp, Artificial Sequence
  dgRNA
  Cxcr1
accctgctaagccta

SEQ ID NO: 61377 - DNA, 15 bp, Artificial Sequence
  dgRNA
  Cxcr1
aatctctgatactgc

SEQ ID NO: 61378 - DNA, 15 bp, Artificial Sequence
  dgRNA
  Cxcr1
cccaaatgcagatgt

SEQ ID NO: 61379 - DNA, 15 bp, Artificial Sequence
  dgRNA
  Cxcr1
tgggcggggctctag

SEQ ID NO: 61380 - DNA, 15 bp, Artificial Sequence
  dgRNA
  Cish
tgcctactagtctct

SEQ ID NO: 61381 - DNA, 15 bp, Artificial Sequence
  dgRNA
  Cish
aggtcccgccccact

SEQ ID NO: 61382 - DNA, 15 bp, Artificial Sequence
  dgRNA
  Cish
ggtcccgccccactc

SEQ ID NO: 61383 - DNA, 15 bp, Artificial Sequence
  dgRNA
  Cish
cgggcacgtcagttc

SEQ ID NO: 61384 - DNA, 15 bp, Artificial Sequence
  dgRNA
  Apoc2
gtcttgtacaaggcc

SEQ ID NO: 61385 - DNA, 15 bp, Artificial Sequence
  dgRNA
  Apoc2
ggcggcacactgttt

SEQ ID NO: 61386 - DNA, 15 bp, Artificial Sequence
  dgRNA
  Apoc2
cctgccaaggagtgt

SEQ ID NO: 61387 - DNA, 15 bp, Artificial Sequence
  dgRNA
  Apoc2
tccccggtgaaagag

SEQ ID NO: 61388 - DNA, 15 bp, Artificial Sequence
  dgRNA
  T
cctcggctgtattta

SEQ ID NO: 61389 - DNA, 15 bp, Artificial Sequence
  dgRNA
  T
ctcggctgtatttat

SEQ ID NO: 61390 - DNA, 15 bp, Artificial Sequence
  dgRNA
  T
tcggctgtatttatg

SEQ ID NO: 61391 - DNA, 15 bp, Artificial Sequence
  dgRNA
  T
tcttgtcgcgccttg

SEQ ID NO: 61392 - DNA, 15 bp, Artificial Sequence
  dgRNA
  Hoxd11
agcgtgcgcgcgtct

SEQ ID NO: 61393 - DNA, 15 bp, Artificial Sequence
  dgRNA
  Hoxd11
gcgcgtctcggcgcc

SEQ ID NO: 61394 - DNA, 15 bp, Artificial Sequence
  dgRNA
  Hoxd11
cgccaggagccgtcc

SEQ ID NO: 61395 - DNA, 15 bp, Artificial Sequence
  dgRNA
  Hoxd11
gccaggagccgtccc

SEQ ID NO: 61396 - DNA, 15 bp, Artificial Sequence
  dgRNA
  Plekha5
cacgggggagggctt

SEQ ID NO: 61397 - DNA, 15 bp, Artificial Sequence
  dgRNA
  Plekha5
gggagggctttggcg

SEQ ID NO: 61398 - DNA, 15 bp, Artificial Sequence
  dgRNA
  Plekha5
cgagcgagcgcagcg

SEQ ID NO: 61399 - DNA, 15 bp, Artificial Sequence
  dgRNA
  Plekha5
gagcgagcgcagcgc

SEQ ID NO: 61400 - DNA, 15 bp, Artificial Sequence
  dgRNA
  Pcdhb2
gcttgaaaagaacgc

SEQ ID NO: 61401 - DNA, 15 bp, Artificial Sequence
  dgRNA
  Pcdhb2
cttgaaaagaacgca

SEQ ID NO: 61402 - DNA, 15 bp, Artificial Sequence
  dgRNA
  Pcdhb2
tgtaaggcgtggata

SEQ ID NO: 61403 - DNA, 15 bp, Artificial Sequence
  dgRNA
  Pcdhb2
atactatgtaaggcg

SEQ ID NO: 61404 - DNA, 15 bp, Artificial Sequence
  dgRNA
  Zfp352
ctggaggcggatata

SEQ ID NO: 61405 - DNA, 15 bp, Artificial Sequence
  dgRNA
  Zfp352
gcggatataaggcca

SEQ ID NO: 61406 - DNA, 15 bp, Artificial Sequence
  dgRNA
  Zfp352
cggatataaggccat

SEQ ID NO: 61407 - DNA, 15 bp, Artificial Sequence
  dgRNA
  Slc22a18
acctcgcaagccccg

SEQ ID NO: 61408 - DNA, 15 bp, Artificial Sequence
  dgRNA
  Slc22a18
cctcgcaagccccgt

SEQ ID NO: 61409 - DNA, 15 bp, Artificial Sequence
  dgRNA
  Slc22a18
ctcgcaagccccgtg

SEQ ID NO: 61410 - DNA, 15 bp, Artificial Sequence
  dgRNA
  Slc22a18
tcgcaagccccgtgg

SEQ ID NO: 61411 - DNA, 15 bp, Artificial Sequence
  dgRNA
  Gfap
gggttccttgatcaa

SEQ ID NO: 61412 - DNA, 15 bp, Artificial Sequence
  dgRNA
  Gfap
atcaatggcgaagcc

SEQ ID NO: 61413 - DNA, 15 bp, Artificial Sequence
  dgRNA
  Gfap
agttctccccctagc

SEQ ID NO: 61414 - DNA, 15 bp, Artificial Sequence
  dgRNA
  Gfap
gttctccccctagct

SEQ ID NO: 61415 - DNA, 15 bp, Artificial Sequence
  dgRNA
  Gpm6b
cgtcagggcccctct

SEQ ID NO: 61416 - DNA, 15 bp, Artificial Sequence
  dgRNA
  Gpm6b
gggcccctctcggca

SEQ ID NO: 61417 - DNA, 15 bp, Artificial Sequence
  dgRNA
  Gpm6b
ccctctcggcacggc

SEQ ID NO: 61418 - DNA, 15 bp, Artificial Sequence
  dgRNA
  Gpm6b
gccggcccccagtgc

SEQ ID NO: 61419 - DNA, 15 bp, Artificial Sequence
  dgRNA
  Ttc9c
tcctccgatatcgtg

SEQ ID NO: 61420 - DNA, 15 bp, Artificial Sequence
  dgRNA
  Ttc9c
tattggagaagtggc

SEQ ID NO: 61421 - DNA, 15 bp, Artificial Sequence
  dgRNA
  Ttc9c
tccgggttggtccgc

SEQ ID NO: 61422 - DNA, 15 bp, Artificial Sequence
  dgRNA
  Ttc9c
ccgggttggtccgct

SEQ ID NO: 61423 - DNA, 15 bp, Artificial Sequence
  dgRNA
  Cdc14b
ggacgtcctagagtt

SEQ ID NO: 61424 - DNA, 15 bp, Artificial Sequence
  dgRNA
  Cdc14b
gagtttggacttccg

SEQ ID NO: 61425 - DNA, 15 bp, Artificial Sequence
  dgRNA
  Cdc14b
ttggacttccggggt

SEQ ID NO: 61426 - DNA, 15 bp, Artificial Sequence
  dgRNA
  Cdc14b
tgcttgtcacccgcc

SEQ ID NO: 61427 - DNA, 15 bp, Artificial Sequence
  dgRNA
  Pcif1
accacccagatcaac

SEQ ID NO: 61428 - DNA, 15 bp, Artificial Sequence
  dgRNA
  Pcif1
agatcaaccggaaaa

SEQ ID NO: 61429 - DNA, 15 bp, Artificial Sequence
  dgRNA
  Pcif1
gatcaaccggaaaat

SEQ ID NO: 61430 - DNA, 15 bp, Artificial Sequence
  dgRNA
  Pcif1
atcaaccggaaaatg

SEQ ID NO: 61431 - DNA, 15 bp, Artificial Sequence
  dgRNA
  Ncor1
gcagcgctgccgggg

SEQ ID NO: 61432 - DNA, 15 bp, Artificial Sequence
  dgRNA
  Ncor1
cagcgctgccggggc

SEQ ID NO: 61433 - DNA, 15 bp, Artificial Sequence
  dgRNA
  Ncor1
gcgggcatgagtgcg

SEQ ID NO: 61434 - DNA, 15 bp, Artificial Sequence
  dgRNA
  Ncor1
cgggcatgagtgcga

SEQ ID NO: 61435 - DNA, 15 bp, Artificial Sequence
  dgRNA
  Hist1h2bl
acggagagatttcat

SEQ ID NO: 61436 - DNA, 15 bp, Artificial Sequence
  dgRNA
  Hist1h2bl
ttaccaatggcgccc

SEQ ID NO: 61437 - DNA, 15 bp, Artificial Sequence
  dgRNA
  Hist1h2bl
atcccttgttttgat

SEQ ID NO: 61438 - DNA, 15 bp, Artificial Sequence
  dgRNA
  Hist1h2bl
gacgtatggtgattc

SEQ ID NO: 61439 - DNA, 15 bp, Artificial Sequence
  dgRNA
  Ppp1r18
gacaccccgcttctt

SEQ ID NO: 61440 - DNA, 15 bp, Artificial Sequence
  dgRNA
  Ppp1r18
acaccccgcttcttc

SEQ ID NO: 61441 - DNA, 15 bp, Artificial Sequence
  dgRNA
  Ppp1r18
caccccgcttcttcg

SEQ ID NO: 61442 - DNA, 15 bp, Artificial Sequence
  dgRNA
  Ppp1r18
ttcttcggggctgca

SEQ ID NO: 61443 - DNA, 15 bp, Artificial Sequence
  dgRNA
  1700066M21Rik
catgggcccaacctg

SEQ ID NO: 61444 - DNA, 15 bp, Artificial Sequence
  dgRNA
  1700066M21Rik
atgggcccaacctgc

SEQ ID NO: 61445 - DNA, 15 bp, Artificial Sequence
  dgRNA
  1700066M21Rik
tccgttcgaacttcc

SEQ ID NO: 61446 - DNA, 15 bp, Artificial Sequence
  dgRNA
  1700066M21Rik
ttcgaacttcccggc

SEQ ID NO: 61447 - DNA, 15 bp, Artificial Sequence
  dgRNA
  Pou4f3
gggggcggccgcatc

SEQ ID NO: 61448 - DNA, 15 bp, Artificial Sequence
  dgRNA
  Pou4f3
gcgcgccgagacctg

SEQ ID NO: 61449 - DNA, 15 bp, Artificial Sequence
  dgRNA
  Pou4f3
cgcccctgcgagtcc

SEQ ID NO: 61450 - DNA, 15 bp, Artificial Sequence
  dgRNA
  Pou4f3
gcccctgcgagtccc

SEQ ID NO: 61451 - DNA, 15 bp, Artificial Sequence
  dgRNA
  Medag
gggagggccccgcgc

SEQ ID NO: 61452 - DNA, 15 bp, Artificial Sequence
  dgRNA
  Medag
ggagggccccgcgcg

SEQ ID NO: 61453 - DNA, 15 bp, Artificial Sequence
  dgRNA
  Medag
gagggccccgcgcgg

SEQ ID NO: 61454 - DNA, 15 bp, Artificial Sequence
  dgRNA
  Medag
agtgtctgacccgag

SEQ ID NO: 61455 - DNA, 15 bp, Artificial Sequence
  dgRNA
  Atp9b
agtttggtaacaaga

SEQ ID NO: 61456 - DNA, 15 bp, Artificial Sequence
  dgRNA
  Atp9b
atcaggcaacgccaa

SEQ ID NO: 61457 - DNA, 15 bp, Artificial Sequence
  dgRNA
  Atp9b
aggcaacgccaatgg

SEQ ID NO: 61458 - DNA, 15 bp, Artificial Sequence
  dgRNA
  Atp9b
aacgccaatggaggc

SEQ ID NO: 61459 - DNA, 15 bp, Artificial Sequence
  dgRNA
  Zfp771
gatctgggccgcatg

SEQ ID NO: 61460 - DNA, 15 bp, Artificial Sequence
  dgRNA
  Zfp771
atctgggccgcatgc

SEQ ID NO: 61461 - DNA, 15 bp, Artificial Sequence
  dgRNA
  Zfp771
ggcccgctctccagg

SEQ ID NO: 61462 - DNA, 15 bp, Artificial Sequence
  dgRNA
  Zfp771
gcccgctctccaggc

SEQ ID NO: 61463 - DNA, 15 bp, Artificial Sequence
  dgRNA
  Wnt11
gggtgcaaagtgtcc

SEQ ID NO: 61464 - DNA, 15 bp, Artificial Sequence
  dgRNA
  Wnt11
agtgtcccggagcgc

SEQ ID NO: 61465 - DNA, 15 bp, Artificial Sequence
  dgRNA
  Wnt11
gtgtcccggagcgcc

SEQ ID NO: 61466 - DNA, 15 bp, Artificial Sequence
  dgRNA
  Wnt11
tcccggagcgccggg

SEQ ID NO: 61467 - DNA, 15 bp, Artificial Sequence
  dgRNA
  Doc2g
tcacactctgttgaa

SEQ ID NO: 61468 - DNA, 15 bp, Artificial Sequence
  dgRNA
  Prss44
agtcagtcgtggatc

SEQ ID NO: 61469 - DNA, 15 bp, Artificial Sequence
  dgRNA
  Prss44
cagtcgtggatcagg

SEQ ID NO: 61470 - DNA, 15 bp, Artificial Sequence
  dgRNA
  Prss44
aactgtgcgtagcct

SEQ ID NO: 61471 - DNA, 15 bp, Artificial Sequence
  dgRNA
  Prss44
gcgtagcctaggcaa

SEQ ID NO: 61472 - DNA, 15 bp, Artificial Sequence
  dgRNA
  Igfl3
actgatagctgtaag

SEQ ID NO: 61473 - DNA, 15 bp, Artificial Sequence
  dgRNA
  Igfl3
gactgatagctgtaa

SEQ ID NO: 61474 - DNA, 15 bp, Artificial Sequence
  dgRNA
  Igfl3
tgactgatagctgta

SEQ ID NO: 61475 - DNA, 15 bp, Artificial Sequence
  dgRNA
  Slc30a1
cgcgctagccaatag

SEQ ID NO: 61476 - DNA, 15 bp, Artificial Sequence
  dgRNA
  Slc30a1
agccaatagaggccg

SEQ ID NO: 61477 - DNA, 15 bp, Artificial Sequence
  dgRNA
  Slc30a1
ggaagggcgggacgc

SEQ ID NO: 61478 - DNA, 15 bp, Artificial Sequence
  dgRNA
  Slc30a1
gaagggcgggacgcc

SEQ ID NO: 61479 - DNA, 15 bp, Artificial Sequence
  dgRNA
  Shank2
ctcacccctcagcgt

SEQ ID NO: 61480 - DNA, 15 bp, Artificial Sequence
  dgRNA
  Shank2
cagcgttggcctcca

SEQ ID NO: 61481 - DNA, 15 bp, Artificial Sequence
  dgRNA
  Shank2
cgttggcctccatgg

SEQ ID NO: 61482 - DNA, 15 bp, Artificial Sequence
  dgRNA
  Shank2
ttggcctccatggcg

SEQ ID NO: 61483 - DNA, 15 bp, Artificial Sequence
  dgRNA
  Olfr1110
aattgactatggctg

SEQ ID NO: 61484 - DNA, 15 bp, Artificial Sequence
  dgRNA
  Olfr1110
tgatttatcttcccc

SEQ ID NO: 61485 - DNA, 15 bp, Artificial Sequence
  dgRNA
  Olfr1110
gtgaagtgactattt

SEQ ID NO: 61486 - DNA, 15 bp, Artificial Sequence
  dgRNA
  Olfr1110
atgaagagttgccct

SEQ ID NO: 61487 - DNA, 15 bp, Artificial Sequence
  dgRNA
  Cyp2c67
gagttgtaacaagta

SEQ ID NO: 61488 - DNA, 15 bp, Artificial Sequence
  dgRNA
  Arl6ip6
ccacaggacccgaaa

SEQ ID NO: 61489 - DNA, 15 bp, Artificial Sequence
  dgRNA
  Arl6ip6
caggacccgaaaggg

SEQ ID NO: 61490 - DNA, 15 bp, Artificial Sequence
  dgRNA
  Arl6ip6
atgagagtgttgtcg

SEQ ID NO: 61491 - DNA, 15 bp, Artificial Sequence
  dgRNA
  Arl6ip6
agagtgttgtcgcgg

SEQ ID NO: 61492 - DNA, 15 bp, Artificial Sequence
  dgRNA
  Abhd16b
gtcacaaaggccatt

SEQ ID NO: 61493 - DNA, 15 bp, Artificial Sequence
  dgRNA
  Abhd16b
ttggggcctacccag

SEQ ID NO: 61494 - DNA, 15 bp, Artificial Sequence
  dgRNA
  Abhd16b
gggcctacccagagg

SEQ ID NO: 61495 - DNA, 15 bp, Artificial Sequence
  dgRNA
  Abhd16b
atgacatgcctcctc

SEQ ID NO: 61496 - DNA, 15 bp, Artificial Sequence
  dgRNA
  Mme
aacctcccgggactc

SEQ ID NO: 61497 - DNA, 15 bp, Artificial Sequence
  dgRNA
  Mme
ccccctccgcgcgct

SEQ ID NO: 61498 - DNA, 15 bp, Artificial Sequence
  dgRNA
  Mme
cgcgcgctcggcgcc

SEQ ID NO: 61499 - DNA, 15 bp, Artificial Sequence
  dgRNA
  Mme
gcgcgctcggcgccg

SEQ ID NO: 61500 - DNA, 15 bp, Artificial Sequence
  dgRNA
  Sec14l1
cggagcgagccccag

SEQ ID NO: 61501 - DNA, 15 bp, Artificial Sequence
  dgRNA
  Sec14l1
tggtctgccaggact

SEQ ID NO: 61502 - DNA, 15 bp, Artificial Sequence
  dgRNA
  Zbtb1
ggaccccgagcggac

SEQ ID NO: 61503 - DNA, 15 bp, Artificial Sequence
  dgRNA
  Zbtb1
ggacaggctttaggc

SEQ ID NO: 61504 - DNA, 15 bp, Artificial Sequence
  dgRNA
  Zbtb1
ggctttaggctggac

SEQ ID NO: 61505 - DNA, 15 bp, Artificial Sequence
  dgRNA
  Zbtb1
ccctccaggcgtcca

SEQ ID NO: 61506 - DNA, 15 bp, Artificial Sequence
  dgRNA
  Cenph
acccacaggcttcga

SEQ ID NO: 61507 - DNA, 15 bp, Artificial Sequence
  dgRNA
  Cenph
ttcgatggcctgtgt

SEQ ID NO: 61508 - DNA, 15 bp, Artificial Sequence
  dgRNA
  Cenph
gcagcacggtaacca

SEQ ID NO: 61509 - DNA, 15 bp, Artificial Sequence
  dgRNA
  Cenph
cggcaacccgctgca

SEQ ID NO: 61510 - DNA, 15 bp, Artificial Sequence
  dgRNA
  Olfr791
tataggctggcttgt

SEQ ID NO: 61511 - DNA, 15 bp, Artificial Sequence
  dgRNA
  Olfr791
gtgaaagtctaacaa

SEQ ID NO: 61512 - DNA, 15 bp, Artificial Sequence
  dgRNA
  Mogat2
cttccgcctttagcc

SEQ ID NO: 61513 - DNA, 15 bp, Artificial Sequence
  dgRNA
  Mogat2
cctttagcctggtct

SEQ ID NO: 61514 - DNA, 15 bp, Artificial Sequence
  dgRNA
  Mogat2
gggattacaaggtac

SEQ ID NO: 61515 - DNA, 15 bp, Artificial Sequence
  dgRNA
  Mogat2
ggattacaaggtacg

SEQ ID NO: 61516 - DNA, 15 bp, Artificial Sequence
  dgRNA
  Creb3l3
tagtccccctgcgcc

SEQ ID NO: 61517 - DNA, 15 bp, Artificial Sequence
  dgRNA
  Creb3l3
ccccctgcgccaggc

SEQ ID NO: 61518 - DNA, 15 bp, Artificial Sequence
  dgRNA
  Creb3l3
acccctgcctggcgc

SEQ ID NO: 61519 - DNA, 15 bp, Artificial Sequence
  dgRNA
  Creb3l3
atggaccacacacct

SEQ ID NO: 61520 - DNA, 15 bp, Artificial Sequence
  dgRNA
  Nrtn
gcgcccctacagctg

SEQ ID NO: 61521 - DNA, 15 bp, Artificial Sequence
  dgRNA
  Nrtn
cgcccctacagctgt

SEQ ID NO: 61522 - DNA, 15 bp, Artificial Sequence
  dgRNA
  Nrtn
ggcggttcccgagcc

SEQ ID NO: 61523 - DNA, 15 bp, Artificial Sequence
  dgRNA
  Nrtn
gcggttcccgagccc

SEQ ID NO: 61524 - DNA, 15 bp, Artificial Sequence
  dgRNA
  Gtpbp8
tagttggtaaagcca

SEQ ID NO: 61525 - DNA, 15 bp, Artificial Sequence
  dgRNA
  Gtpbp8
cccctttctgcccgg

SEQ ID NO: 61526 - DNA, 15 bp, Artificial Sequence
  dgRNA
  Gtpbp8
ctttctgcccggagg

SEQ ID NO: 61527 - DNA, 15 bp, Artificial Sequence
  dgRNA
  Gtpbp8
agcgagctttctgtc

SEQ ID NO: 61528 - DNA, 15 bp, Artificial Sequence
  dgRNA
  Rcvrn
cagtgtggctcttcg

SEQ ID NO: 61529 - DNA, 15 bp, Artificial Sequence
  dgRNA
  Rcvrn
agtgtggctcttcgg

SEQ ID NO: 61530 - DNA, 15 bp, Artificial Sequence
  dgRNA
  Rcvrn
ggggcttaaatgccg

SEQ ID NO: 61531 - DNA, 15 bp, Artificial Sequence
  dgRNA
  Rcvrn
aatgccgaggatgct

SEQ ID NO: 61532 - DNA, 15 bp, Artificial Sequence
  dgRNA
  Klk8
tcacctcggtttccg

SEQ ID NO: 61533 - DNA, 15 bp, Artificial Sequence
  dgRNA
  Klk8
ctcctcgagcgcttg

SEQ ID NO: 61534 - DNA, 15 bp, Artificial Sequence
  dgRNA
  Klk8
tcctcgagcgcttgc

SEQ ID NO: 61535 - DNA, 15 bp, Artificial Sequence
  dgRNA
  Klk8
agccgcaccgcagca

SEQ ID NO: 61536 - DNA, 15 bp, Artificial Sequence
  dgRNA
  Icos
gggtacttgccatgc

SEQ ID NO: 61537 - DNA, 15 bp, Artificial Sequence
  dgRNA
  Icos
tacttgccatgcagg

SEQ ID NO: 61538 - DNA, 15 bp, Artificial Sequence
  dgRNA
  Icos
ccggtgatgtatgaa

SEQ ID NO: 61539 - DNA, 15 bp, Artificial Sequence
  dgRNA
  Pbx3
cgcggcggccgcgtg

SEQ ID NO: 61540 - DNA, 15 bp, Artificial Sequence
  dgRNA
  Pbx3
gcggcggccgcgtga

SEQ ID NO: 61541 - DNA, 15 bp, Artificial Sequence
  dgRNA
  Pbx3
gccgcgtgagggcag

SEQ ID NO: 61542 - DNA, 15 bp, Artificial Sequence
  dgRNA
  Pbx3
ccgcgtgagggcagc

SEQ ID NO: 61543 - DNA, 15 bp, Artificial Sequence
  dgRNA
  Aplnr
ccaacccttctaaat

SEQ ID NO: 61544 - DNA, 15 bp, Artificial Sequence
  dgRNA
  Slc24a2
cttacccatgaacac

SEQ ID NO: 61545 - DNA, 15 bp, Artificial Sequence
  dgRNA
  Slc24a2
tgacgccttgtcctg

SEQ ID NO: 61546 - DNA, 15 bp, Artificial Sequence
  dgRNA
  Cd2ap
gagcggaagcggccc

SEQ ID NO: 61547 - DNA, 15 bp, Artificial Sequence
  dgRNA
  Cd2ap
ccctgtgctcaggcg

SEQ ID NO: 61548 - DNA, 15 bp, Artificial Sequence
  dgRNA
  Cd2ap
cacccccgcctgccg

SEQ ID NO: 61549 - DNA, 15 bp, Artificial Sequence
  dgRNA
  Cd2ap
gcggtggcaagccac

SEQ ID NO: 61550 - DNA, 15 bp, Artificial Sequence
  dgRNA
  Zfp110
cagacagccccaatc

SEQ ID NO: 61551 - DNA, 15 bp, Artificial Sequence
  dgRNA
  Zfp110
cactagtagagccgt

SEQ ID NO: 61552 - DNA, 15 bp, Artificial Sequence
  dgRNA
  Zfp110
ccttgctctgctacg

SEQ ID NO: 61553 - DNA, 15 bp, Artificial Sequence
  dgRNA
  Zfp110
agggaatccggattg

SEQ ID NO: 61554 - DNA, 15 bp, Artificial Sequence
  dgRNA
  Specc1
acgactacccatcaa

SEQ ID NO: 61555 - DNA, 15 bp, Artificial Sequence
  dgRNA
  Specc1
actacccatcaatgg

SEQ ID NO: 61556 - DNA, 15 bp, Artificial Sequence
  dgRNA
  Specc1
gtcgatgagaacaca

SEQ ID NO: 61557 - DNA, 15 bp, Artificial Sequence
  dgRNA
  Specc1
accgctagatgagaa

SEQ ID NO: 61558 - DNA, 15 bp, Artificial Sequence
  dgRNA
  Abca12
agcgcctgccacagc

SEQ ID NO: 61559 - DNA, 15 bp, Artificial Sequence
  dgRNA
  Abca12
ggactatgtgtaggg

SEQ ID NO: 61560 - DNA, 15 bp, Artificial Sequence
  dgRNA
  Abca12
caggacaagtcctac

SEQ ID NO: 61561 - DNA, 15 bp, Artificial Sequence
  dgRNA
  Abca12
cctactggcccttcc

SEQ ID NO: 61562 - DNA, 15 bp, Artificial Sequence
  dgRNA
  Rnf145
gccccgcaggcaggg

SEQ ID NO: 61563 - DNA, 15 bp, Artificial Sequence
  dgRNA
  Rnf145
gtgactgcggtcagc

SEQ ID NO: 61564 - DNA, 15 bp, Artificial Sequence
  dgRNA
  Rnf145
tgactgcggtcagcc

SEQ ID NO: 61565 - DNA, 15 bp, Artificial Sequence
  dgRNA
  Rnf145
ccgggagcatcccgc

SEQ ID NO: 61566 - DNA, 15 bp, Artificial Sequence
  dgRNA
  Dhtkd1
agagggtgactatta

SEQ ID NO: 61567 - DNA, 15 bp, Artificial Sequence
  dgRNA
  Dhtkd1
gggtgactattaagg

SEQ ID NO: 61568 - DNA, 15 bp, Artificial Sequence
  dgRNA
  Dhtkd1
ggtgactattaaggc

SEQ ID NO: 61569 - DNA, 15 bp, Artificial Sequence
  dgRNA
  Dhtkd1
tcgccagccttgcac

SEQ ID NO: 61570 - DNA, 15 bp, Artificial Sequence
  dgRNA
  Ltb4r1
tcttttggactgcgt

SEQ ID NO: 61571 - DNA, 15 bp, Artificial Sequence
  dgRNA
  Ltb4r1
gagtagtagccagaa

SEQ ID NO: 61572 - DNA, 15 bp, Artificial Sequence
  dgRNA
  Ltb4r1
gaagactctttgggt

SEQ ID NO: 61573 - DNA, 15 bp, Artificial Sequence
  dgRNA
  Ltb4r1
cgcagtccaaaagag

SEQ ID NO: 61574 - DNA, 15 bp, Artificial Sequence
  dgRNA
  Htr1a
aagactcctggctac

SEQ ID NO: 61575 - DNA, 15 bp, Artificial Sequence
  dgRNA
  Htr1a
gaggcactcgggact

SEQ ID NO: 61576 - DNA, 15 bp, Artificial Sequence
  dgRNA
  Htr1a
aggcactcgggacta

SEQ ID NO: 61577 - DNA, 15 bp, Artificial Sequence
  dgRNA
  Htr1a
agtgttggatggcgg

SEQ ID NO: 61578 - DNA, 15 bp, Artificial Sequence
  dgRNA
  Ralgps2
gccgactgctcggtt

SEQ ID NO: 61579 - DNA, 15 bp, Artificial Sequence
  dgRNA
  Ralgps2
ggcgagcgattgcct

SEQ ID NO: 61580 - DNA, 15 bp, Artificial Sequence
  dgRNA
  Ralgps2
attgcctcggagccg

SEQ ID NO: 61581 - DNA, 15 bp, Artificial Sequence
  dgRNA
  Ralgps2
ttgcctcggagccgc

SEQ ID NO: 61582 - DNA, 15 bp, Artificial Sequence
  dgRNA
  Cldn10
tcaagctatttgccg

SEQ ID NO: 61583 - DNA, 15 bp, Artificial Sequence
  dgRNA
  Cldn10
caagctatttgccgc

SEQ ID NO: 61584 - DNA, 15 bp, Artificial Sequence
  dgRNA
  Cldn10
ctatttgccgcgggt

SEQ ID NO: 61585 - DNA, 15 bp, Artificial Sequence
  dgRNA
  Cldn10
tatttgccgcgggta

SEQ ID NO: 61586 - DNA, 15 bp, Artificial Sequence
  dgRNA
  Klhl41
tcccgttgttagagc

SEQ ID NO: 61587 - DNA, 15 bp, Artificial Sequence
  dgRNA
  Klhl41
gtgtctatatttagc

SEQ ID NO: 61588 - DNA, 15 bp, Artificial Sequence
  dgRNA
  Klhl41
tctatatttagccgg

SEQ ID NO: 61589 - DNA, 15 bp, Artificial Sequence
  dgRNA
  Klhl41
ctatatttagccggt

SEQ ID NO: 61590 - DNA, 15 bp, Artificial Sequence
  dgRNA
  Lyrm2
aatttgccagcataa

SEQ ID NO: 61591 - DNA, 15 bp, Artificial Sequence
  dgRNA
  Lyrm2
ttgccagcataatgg

SEQ ID NO: 61592 - DNA, 15 bp, Artificial Sequence
  dgRNA
  Lyrm2
gcaagggtgctcaaa

SEQ ID NO: 61593 - DNA, 15 bp, Artificial Sequence
  dgRNA
  Lyrm2
aagcgaccgagctcc

SEQ ID NO: 61594 - DNA, 15 bp, Artificial Sequence
  dgRNA
  Nfyb
gcaagcctttccgcg

SEQ ID NO: 61595 - DNA, 15 bp, Artificial Sequence
  dgRNA
  Nfyb
ttccgcgtggagctc

SEQ ID NO: 61596 - DNA, 15 bp, Artificial Sequence
  dgRNA
  Nfyb
tctggatgagaacgc

SEQ ID NO: 61597 - DNA, 15 bp, Artificial Sequence
  dgRNA
  Nfyb
agaacgccggcctct

SEQ ID NO: 61598 - DNA, 15 bp, Artificial Sequence
  dgRNA
  Mkx
ggctcccgtcttggc

SEQ ID NO: 61599 - DNA, 15 bp, Artificial Sequence
  dgRNA
  Mkx
tcccgtcttggccgg

SEQ ID NO: 61600 - DNA, 15 bp, Artificial Sequence
  dgRNA
  Mkx
ctcccgccgcccgac

SEQ ID NO: 61601 - DNA, 15 bp, Artificial Sequence
  dgRNA
  Mkx
tcctctctcgccgcc

SEQ ID NO: 61602 - DNA, 15 bp, Artificial Sequence
  dgRNA
  E030018B13Rik
tctcatggaacacga

SEQ ID NO: 61603 - DNA, 15 bp, Artificial Sequence
  dgRNA
  E030018B13Rik
aacacgatggcacaa

SEQ ID NO: 61604 - DNA, 15 bp, Artificial Sequence
  dgRNA
  E030018B13Rik
acacgatggcacaag

SEQ ID NO: 61605 - DNA, 15 bp, Artificial Sequence
  dgRNA
  E030018B13Rik
cacgatggcacaagg

SEQ ID NO: 61606 - DNA, 15 bp, Artificial Sequence
  dgRNA
  Slc17a2
gttgagatactcact

SEQ ID NO: 61607 - DNA, 15 bp, Artificial Sequence
  dgRNA
  Slc17a2
agatactcactaggt

SEQ ID NO: 61608 - DNA, 15 bp, Artificial Sequence
  dgRNA
  Slc17a2
gcacagggtcaaacc

SEQ ID NO: 61609 - DNA, 15 bp, Artificial Sequence
  dgRNA
  Slc17a2
tagtgagtatctcaa

SEQ ID NO: 61610 - DNA, 15 bp, Artificial Sequence
  dgRNA
  Clec3b
gactttctcggagcc

SEQ ID NO: 61611 - DNA, 15 bp, Artificial Sequence
  dgRNA
  Clec3b
tctcggagcctggcc

SEQ ID NO: 61612 - DNA, 15 bp, Artificial Sequence
  dgRNA
  Clec3b
atagctacactgctg

SEQ ID NO: 61613 - DNA, 15 bp, Artificial Sequence
  dgRNA
  Ly96
gctgttttaaagtgc

SEQ ID NO: 61614 - DNA, 15 bp, Artificial Sequence
  dgRNA
  4930433I11Rik
atgttagctggttaa

SEQ ID NO: 61615 - DNA, 15 bp, Artificial Sequence
  dgRNA
  4930433I11Rik
gggtaagatgttagc

SEQ ID NO: 61616 - DNA, 15 bp, Artificial Sequence
  dgRNA
  Ctla4
atgtagcacgtacct

SEQ ID NO: 61617 - DNA, 15 bp, Artificial Sequence
  dgRNA
  Ctla4
gtccccgagtctgtg

SEQ ID NO: 61618 - DNA, 15 bp, Artificial Sequence
  dgRNA
  Zfp219
cgcctctgtgcgcga

SEQ ID NO: 61619 - DNA, 15 bp, Artificial Sequence
  dgRNA
  Zfp219
gcgcgacggccctcc

SEQ ID NO: 61620 - DNA, 15 bp, Artificial Sequence
  dgRNA
  Zfp219
gcgcctccccgcacg

SEQ ID NO: 61621 - DNA, 15 bp, Artificial Sequence
  dgRNA
  Zfp219
cgcctccccgcacgc

SEQ ID NO: 61622 - DNA, 15 bp, Artificial Sequence
  dgRNA
  Grm7
cgtgatgatgcaaac

SEQ ID NO: 61623 - DNA, 15 bp, Artificial Sequence
  dgRNA
  Grm7
gatgatgcaaaccgg

SEQ ID NO: 61624 - DNA, 15 bp, Artificial Sequence
  dgRNA
  Grm7
atgatgcaaaccggt

SEQ ID NO: 61625 - DNA, 15 bp, Artificial Sequence
  dgRNA
  Grm7
tgatgcaaaccggtg

SEQ ID NO: 61626 - DNA, 15 bp, Artificial Sequence
  dgRNA
  Plk3
cctttaagaacgccc

SEQ ID NO: 61627 - DNA, 15 bp, Artificial Sequence
  dgRNA
  Plk3
aagaacgcccaggca

SEQ ID NO: 61628 - DNA, 15 bp, Artificial Sequence
  dgRNA
  Plk3
agaacgcccaggcaa

SEQ ID NO: 61629 - DNA, 15 bp, Artificial Sequence
  dgRNA
  Plk3
ctttcaggtgacgta

SEQ ID NO: 61630 - DNA, 15 bp, Artificial Sequence
  dgRNA
  Mrps10
tctgcccgacccgta

SEQ ID NO: 61631 - DNA, 15 bp, Artificial Sequence
  dgRNA
  Mrps10
ggagtcatcctccgt

SEQ ID NO: 61632 - DNA, 15 bp, Artificial Sequence
  dgRNA
  Mrps10
gtcatcctccgttgg

SEQ ID NO: 61633 - DNA, 15 bp, Artificial Sequence
  dgRNA
  Mrps10
caggtttttctctcg

SEQ ID NO: 61634 - DNA, 15 bp, Artificial Sequence
  dgRNA
  Pcdhac2
gttacggcaccgccc

SEQ ID NO: 61635 - DNA, 15 bp, Artificial Sequence
  dgRNA
  Pcdhac2
tggggagcttatagt

SEQ ID NO: 61636 - DNA, 15 bp, Artificial Sequence
  dgRNA
  Pcdhac2
atagtaggagttcta

SEQ ID NO: 61637 - DNA, 15 bp, Artificial Sequence
  dgRNA
  Pcdhac2
cgcgttaagcctgct

SEQ ID NO: 61638 - DNA, 15 bp, Artificial Sequence
  dgRNA
  Usp44
tagaagagttgcaac

SEQ ID NO: 61639 - DNA, 15 bp, Artificial Sequence
  dgRNA
  Usp44
gacgagtttctactt

SEQ ID NO: 61640 - DNA, 15 bp, Artificial Sequence
  dgRNA
  Usp44
aaacatcatttaccc

SEQ ID NO: 61641 - DNA, 15 bp, Artificial Sequence
  dgRNA
  Usp44
ttaccctggattcga

SEQ ID NO: 61642 - DNA, 15 bp, Artificial Sequence
  dgRNA
  Mpp5
cctctctccgggccg

SEQ ID NO: 61643 - DNA, 15 bp, Artificial Sequence
  dgRNA
  Mpp5
ctctctccgggccgt

SEQ ID NO: 61644 - DNA, 15 bp, Artificial Sequence
  dgRNA
  Mpp5
ctccgggccgtgggc

SEQ ID NO: 61645 - DNA, 15 bp, Artificial Sequence
  dgRNA
  Mpp5
gggccgcgccaggaa

SEQ ID NO: 61646 - DNA, 15 bp, Artificial Sequence
  dgRNA
  Zfp473
ttttcggggtgtaga

SEQ ID NO: 61647 - DNA, 15 bp, Artificial Sequence
  dgRNA
  Zfp473
aagtagtcctataac

SEQ ID NO: 61648 - DNA, 15 bp, Artificial Sequence
  dgRNA
  Zfp473
agtagtcctataaca

SEQ ID NO: 61649 - DNA, 15 bp, Artificial Sequence
  dgRNA
  Zfp473
cctataacagggtag

SEQ ID NO: 61650 - DNA, 15 bp, Artificial Sequence
  dgRNA
  Asb13
tggacgtatattcac

SEQ ID NO: 61651 - DNA, 15 bp, Artificial Sequence
  dgRNA
  Asb13
tcactggtgtcaaca

SEQ ID NO: 61652 - DNA, 15 bp, Artificial Sequence
  dgRNA
  Asb13
gcagtgacagcggag

SEQ ID NO: 61653 - DNA, 15 bp, Artificial Sequence
  dgRNA
  Asb13
cagtgacagcggagt

SEQ ID NO: 61654 - DNA, 15 bp, Artificial Sequence
  dgRNA
  Tecr
accgcaacactgcaa

SEQ ID NO: 61655 - DNA, 15 bp, Artificial Sequence
  dgRNA
  Tecr
ccgcaacactgcaat

SEQ ID NO: 61656 - DNA, 15 bp, Artificial Sequence
  dgRNA
  Tecr
caacactgcaatggg

SEQ ID NO: 61657 - DNA, 15 bp, Artificial Sequence
  dgRNA
  Tecr
atgggcggagccaga

SEQ ID NO: 61658 - DNA, 15 bp, Artificial Sequence
  dgRNA
  Smarca2
ctcttttaacttggc

SEQ ID NO: 61659 - DNA, 15 bp, Artificial Sequence
  dgRNA
  Smarca2
ctttttagcaccata

SEQ ID NO: 61660 - DNA, 15 bp, Artificial Sequence
  dgRNA
  Smarca2
tttttagcaccatat

SEQ ID NO: 61661 - DNA, 15 bp, Artificial Sequence
  dgRNA
  Smarca2
ttctttcgtgacgtc

SEQ ID NO: 61662 - DNA, 15 bp, Artificial Sequence
  dgRNA
  Cep89
tgataggtaaaagat

SEQ ID NO: 61663 - DNA, 15 bp, Artificial Sequence
  dgRNA
  Cep89
tagccaataatcgaa

SEQ ID NO: 61664 - DNA, 15 bp, Artificial Sequence
  dgRNA
  Cep89
tgaatgacgccttgc

SEQ ID NO: 61665 - DNA, 15 bp, Artificial Sequence
  dgRNA
  Cep89
gttgtcaagagcaac

SEQ ID NO: 61666 - DNA, 15 bp, Artificial Sequence
  dgRNA
  Lrrn3
gtgtgacaactgatc

SEQ ID NO: 61667 - DNA, 15 bp, Artificial Sequence
  dgRNA
  Lrrn3
accaccatggaaacg

SEQ ID NO: 61668 - DNA, 15 bp, Artificial Sequence
  dgRNA
  Lrrn3
ataacgccagctagc

SEQ ID NO: 61669 - DNA, 15 bp, Artificial Sequence
  dgRNA
  Lrrn3
cttcacgggattgag

SEQ ID NO: 61670 - DNA, 15 bp, Artificial Sequence
  dgRNA
  Erp27
gacccgacttccttc

SEQ ID NO: 61671 - DNA, 15 bp, Artificial Sequence
  dgRNA
  Erp27
cgacttccttctggc

SEQ ID NO: 61672 - DNA, 15 bp, Artificial Sequence
  dgRNA
  Erp27
gccacttatcacaga

SEQ ID NO: 61673 - DNA, 15 bp, Artificial Sequence
  dgRNA
  Erp27
gtgaaagttcccccc

SEQ ID NO: 61674 - DNA, 15 bp, Artificial Sequence
  dgRNA
  Smok2a
tttgaactatcacac

SEQ ID NO: 61675 - DNA, 15 bp, Artificial Sequence
  dgRNA
  Col19a1
tccgtgctcaccgag

SEQ ID NO: 61676 - DNA, 15 bp, Artificial Sequence
  dgRNA
  Col19a1
ccgtgctcaccgagt

SEQ ID NO: 61677 - DNA, 15 bp, Artificial Sequence
  dgRNA
  Col19a1
tgctcaccgagtggg

SEQ ID NO: 61678 - DNA, 15 bp, Artificial Sequence
  dgRNA
  Col19a1
gctcaccgagtggga

SEQ ID NO: 61679 - DNA, 15 bp, Artificial Sequence
  dgRNA
  Ldlrad1
tgtcctttcctccgt

SEQ ID NO: 61680 - DNA, 15 bp, Artificial Sequence
  dgRNA
  Ldlrad1
gtcctttcctccgtg

SEQ ID NO: 61681 - DNA, 15 bp, Artificial Sequence
  dgRNA
  Ldlrad1
cccttggtgacaagg

SEQ ID NO: 61682 - DNA, 15 bp, Artificial Sequence
  dgRNA
  Ldlrad1
accacgtctttccct

SEQ ID NO: 61683 - DNA, 15 bp, Artificial Sequence
  dgRNA
  Rph3al
catggcacttaacct

SEQ ID NO: 61684 - DNA, 15 bp, Artificial Sequence
  dgRNA
  Rph3al
acttaaccttggatc

SEQ ID NO: 61685 - DNA, 15 bp, Artificial Sequence
  dgRNA
  Rph3al
cttaaccttggatct

SEQ ID NO: 61686 - DNA, 15 bp, Artificial Sequence
  dgRNA
  Rph3al
gtttccaggaacgag

SEQ ID NO: 61687 - DNA, 15 bp, Artificial Sequence
  dgRNA
  Isoc1
tggtctggtcctccg

SEQ ID NO: 61688 - DNA, 15 bp, Artificial Sequence
  dgRNA
  Isoc1
tctggtcctccgcgg

SEQ ID NO: 61689 - DNA, 15 bp, Artificial Sequence
  dgRNA
  Isoc1
cctgcgactgctgtc

SEQ ID NO: 61690 - DNA, 15 bp, Artificial Sequence
  dgRNA
  Isoc1
tgtccggtctccacc

SEQ ID NO: 61691 - DNA, 15 bp, Artificial Sequence
  dgRNA
  Dusp26
acctagctgctgacc

SEQ ID NO: 61692 - DNA, 15 bp, Artificial Sequence
  dgRNA
  Dusp26
gaagtgcctagcata

SEQ ID NO: 61693 - DNA, 15 bp, Artificial Sequence
  dgRNA
  Dusp26
acgctattaatagta

SEQ ID NO: 61694 - DNA, 15 bp, Artificial Sequence
  dgRNA
  Dusp26
cgctattaatagtaa

SEQ ID NO: 61695 - DNA, 15 bp, Artificial Sequence
  dgRNA
  Pde4b
gcagcttgtttgata

SEQ ID NO: 61696 - DNA, 15 bp, Artificial Sequence
  dgRNA
  Pde4b
accccatccacaagg

SEQ ID NO: 61697 - DNA, 15 bp, Artificial Sequence
  dgRNA
  Rnf43
tccgtacagaggcgg

SEQ ID NO: 61698 - DNA, 15 bp, Artificial Sequence
  dgRNA
  Rnf43
ccgtacagaggcgga

SEQ ID NO: 61699 - DNA, 15 bp, Artificial Sequence
  dgRNA
  Rnf43
cagtagctctcgtct

SEQ ID NO: 61700 - DNA, 15 bp, Artificial Sequence
  dgRNA
  Rnf43
tttgcctgatctgcg

SEQ ID NO: 61701 - DNA, 15 bp, Artificial Sequence
  dgRNA
  Vdac2
ggcggtgaaccgaga

SEQ ID NO: 61702 - DNA, 15 bp, Artificial Sequence
  dgRNA
  Vdac2
gcggtgaaccgagat

SEQ ID NO: 61703 - DNA, 15 bp, Artificial Sequence
  dgRNA
  Vdac2
tcatccccctcaacc

SEQ ID NO: 61704 - DNA, 15 bp, Artificial Sequence
  dgRNA
  Vdac2
taagttcagacctcc

SEQ ID NO: 61705 - DNA, 15 bp, Artificial Sequence
  dgRNA
  Mblac1
ccgactataagccta

SEQ ID NO: 61706 - DNA, 15 bp, Artificial Sequence
  dgRNA
  Mblac1
cgactataagcctaa

SEQ ID NO: 61707 - DNA, 15 bp, Artificial Sequence
  dgRNA
  Mblac1
gactataagcctaag

SEQ ID NO: 61708 - DNA, 15 bp, Artificial Sequence
  dgRNA
  Mblac1
actataagcctaagg

SEQ ID NO: 61709 - DNA, 15 bp, Artificial Sequence
  dgRNA
  Gabrg2
tttttgtcccgtgaa

SEQ ID NO: 61710 - DNA, 15 bp, Artificial Sequence
  dgRNA
  Gabrg2
ctagtctgctgctac

SEQ ID NO: 61711 - DNA, 15 bp, Artificial Sequence
  dgRNA
  Gabrg2
agggttaaagagtgc

SEQ ID NO: 61712 - DNA, 15 bp, Artificial Sequence
  dgRNA
  Gabrg2
tcattgcatcgtgtg

SEQ ID NO: 61713 - DNA, 15 bp, Artificial Sequence
  dgRNA
  Mcfd2
agggccctagcagta

SEQ ID NO: 61714 - DNA, 15 bp, Artificial Sequence
  dgRNA
  Mcfd2
gtagggtgtcgccct

SEQ ID NO: 61715 - DNA, 15 bp, Artificial Sequence
  dgRNA
  Mcfd2
tagggtgtcgccctc

SEQ ID NO: 61716 - DNA, 15 bp, Artificial Sequence
  dgRNA
  Mcfd2
ggtgtcgccctcggg

SEQ ID NO: 61717 - DNA, 15 bp, Artificial Sequence
  dgRNA
  Tlx3
gttgatcgcagccaa

SEQ ID NO: 61718 - DNA, 15 bp, Artificial Sequence
  dgRNA
  Tlx3
gccaatggctgcggc

SEQ ID NO: 61719 - DNA, 15 bp, Artificial Sequence
  dgRNA
  Tlx3
agcagcggaaactcc

SEQ ID NO: 61720 - DNA, 15 bp, Artificial Sequence
  dgRNA
  Tlx3
attagccgggataat

SEQ ID NO: 61721 - DNA, 15 bp, Artificial Sequence
  dgRNA
  Kprp
ggaaactctggcacc

SEQ ID NO: 61722 - DNA, 15 bp, Artificial Sequence
  dgRNA
  Kprp
agggaggaaattacg

SEQ ID NO: 61723 - DNA, 15 bp, Artificial Sequence
  dgRNA
  Kprp
gaggaaattacgtgg

SEQ ID NO: 61724 - DNA, 15 bp, Artificial Sequence
  dgRNA
  Kprp
tatgagacaactggt

SEQ ID NO: 61725 - DNA, 15 bp, Artificial Sequence
  dgRNA
  Ercc6l2
aaatctcgcgatatt

SEQ ID NO: 61726 - DNA, 15 bp, Artificial Sequence
  dgRNA
  Ercc6l2
aatctcgcgatattt

SEQ ID NO: 61727 - DNA, 15 bp, Artificial Sequence
  dgRNA
  Ercc6l2
ttcgcgaactgcgcg

SEQ ID NO: 61728 - DNA, 15 bp, Artificial Sequence
  dgRNA
  Ercc6l2
gaggctgacctcgtc

SEQ ID NO: 61729 - DNA, 15 bp, Artificial Sequence
  dgRNA
  Tgm4
ctcctggggctgata

SEQ ID NO: 61730 - DNA, 15 bp, Artificial Sequence
  dgRNA
  Tgm4
ccaagcctcgcccct

SEQ ID NO: 61731 - DNA, 15 bp, Artificial Sequence
  dgRNA
  Tgm4
atgagcctacttcaa

SEQ ID NO: 61732 - DNA, 15 bp, Artificial Sequence
  dgRNA
  Tgm4
caaggggcgaggctt

SEQ ID NO: 61733 - DNA, 15 bp, Artificial Sequence
  dgRNA
  Prp2
taacccagatattga

SEQ ID NO: 61734 - DNA, 15 bp, Artificial Sequence
  dgRNA
  Abr
gggccatggcagccg

SEQ ID NO: 61735 - DNA, 15 bp, Artificial Sequence
  dgRNA
  Abr
ggccatggcagccgg

SEQ ID NO: 61736 - DNA, 15 bp, Artificial Sequence
  dgRNA
  Abr
gccgggggccgccgc

SEQ ID NO: 61737 - DNA, 15 bp, Artificial Sequence
  dgRNA
  Abr
acttcagctacggtg

SEQ ID NO: 61738 - DNA, 15 bp, Artificial Sequence
  dgRNA
  Slc19a1
ctgatacccaaacga

SEQ ID NO: 61739 - DNA, 15 bp, Artificial Sequence
  dgRNA
  Slc19a1
tgatacccaaacgaa

SEQ ID NO: 61740 - DNA, 15 bp, Artificial Sequence
  dgRNA
  Slc19a1
aagggcgtgcacagc

SEQ ID NO: 61741 - DNA, 15 bp, Artificial Sequence
  dgRNA
  Slc19a1
gcagtctatatctag

SEQ ID NO: 61742 - DNA, 15 bp, Artificial Sequence
  dgRNA
  Fgf5
gcgttataaatatcc

SEQ ID NO: 61743 - DNA, 15 bp, Artificial Sequence
  dgRNA
  Fgf5
gcgccgagatccgct

SEQ ID NO: 61744 - DNA, 15 bp, Artificial Sequence
  dgRNA
  Fgf5
cgccgagatccgctc

SEQ ID NO: 61745 - DNA, 15 bp, Artificial Sequence
  dgRNA
  Fgf5
cgagatccgctcggg

SEQ ID NO: 61746 - DNA, 15 bp, Artificial Sequence
  dgRNA
  Exoc6
ggggcgggctccacc

SEQ ID NO: 61747 - DNA, 15 bp, Artificial Sequence
  dgRNA
  Exoc6
gggcgggctccaccc

SEQ ID NO: 61748 - DNA, 15 bp, Artificial Sequence
  dgRNA
  Exoc6
cgggctccacccggg

SEQ ID NO: 61749 - DNA, 15 bp, Artificial Sequence
  dgRNA
  Exoc6
gggctccacccgggc

SEQ ID NO: 61750 - DNA, 15 bp, Artificial Sequence
  dgRNA
  Usmg5
ctcgtccacgagcgt

SEQ ID NO: 61751 - DNA, 15 bp, Artificial Sequence
  dgRNA
  Usmg5
agcgtaggtaagacc

SEQ ID NO: 61752 - DNA, 15 bp, Artificial Sequence
  dgRNA
  Usmg5
gcgtaggtaagacca

SEQ ID NO: 61753 - DNA, 15 bp, Artificial Sequence
  dgRNA
  Usmg5
cttccgttctgacgt

SEQ ID NO: 61754 - DNA, 15 bp, Artificial Sequence
  dgRNA
  Dapk3
actctcgcctagcct

SEQ ID NO: 61755 - DNA, 15 bp, Artificial Sequence
  dgRNA
  Dapk3
ctctcgcctagcctt

SEQ ID NO: 61756 - DNA, 15 bp, Artificial Sequence
  dgRNA
  Dapk3
tccgcttccgctgag

SEQ ID NO: 61757 - DNA, 15 bp, Artificial Sequence
  dgRNA
  Dapk3
tagtccaatgagcgc

SEQ ID NO: 61758 - DNA, 15 bp, Artificial Sequence
  dgRNA
  Pde6c
ttgtaaggtaaccag

SEQ ID NO: 61759 - DNA, 15 bp, Artificial Sequence
  dgRNA
  Pde6c
gtagatgttgccgcc

SEQ ID NO: 61760 - DNA, 15 bp, Artificial Sequence
  dgRNA
  Pde6c
acttataggctaata

SEQ ID NO: 61761 - DNA, 15 bp, Artificial Sequence
  dgRNA
  Pde6c
aatctttgaacagcc

SEQ ID NO: 61762 - DNA, 15 bp, Artificial Sequence
  dgRNA
  Zfp568
agcacttgcactaaa

SEQ ID NO: 61763 - DNA, 15 bp, Artificial Sequence
  dgRNA
  Vmn1r50
tgggattcgtgaaca

SEQ ID NO: 61764 - DNA, 15 bp, Artificial Sequence
  dgRNA
  Vmn1r50
caaccaacacctaga

SEQ ID NO: 61765 - DNA, 15 bp, Artificial Sequence
  dgRNA
  Far1
gcggctgaagaagag

SEQ ID NO: 61766 - DNA, 15 bp, Artificial Sequence
  dgRNA
  Far1
gtgagcggttctccc

SEQ ID NO: 61767 - DNA, 15 bp, Artificial Sequence
  dgRNA
  Far1
gagcaagagccaatc

SEQ ID NO: 61768 - DNA, 15 bp, Artificial Sequence
  dgRNA
  Far1
aatcaggagcagacg

SEQ ID NO: 61769 - DNA, 15 bp, Artificial Sequence
  dgRNA
  Clcn4
tccacacggaccgtc

SEQ ID NO: 61770 - DNA, 15 bp, Artificial Sequence
  dgRNA
  Clcn4
gaccgtctggacccc

SEQ ID NO: 61771 - DNA, 15 bp, Artificial Sequence
  dgRNA
  Clcn4
gaaaaacctccgatc

SEQ ID NO: 61772 - DNA, 15 bp, Artificial Sequence
  dgRNA
  Clcn4
tccagacggtccgtg

SEQ ID NO: 61773 - DNA, 15 bp, Artificial Sequence
  dgRNA
  Sbk2
tcgctctgcccccaa

SEQ ID NO: 61774 - DNA, 15 bp, Artificial Sequence
  dgRNA
  Sbk2
cgctctgcccccaat

SEQ ID NO: 61775 - DNA, 15 bp, Artificial Sequence
  dgRNA
  Sbk2
gctctgcccccaatg

SEQ ID NO: 61776 - DNA, 15 bp, Artificial Sequence
  dgRNA
  Sbk2
cgaacccccagagtg

SEQ ID NO: 61777 - DNA, 15 bp, Artificial Sequence
  dgRNA
  Hist1h2bm
taacagcgtgtatat

SEQ ID NO: 61778 - DNA, 15 bp, Artificial Sequence
  dgRNA
  Hist1h2bm
aacagcgtgtatata

SEQ ID NO: 61779 - DNA, 15 bp, Artificial Sequence
  dgRNA
  Hist1h2bm
tagtcgcatgtttat

SEQ ID NO: 61780 - DNA, 15 bp, Artificial Sequence
  dgRNA
  Tada3
gatattcagatctcc

SEQ ID NO: 61781 - DNA, 15 bp, Artificial Sequence
  dgRNA
  Tada3
atattcagatctccg

SEQ ID NO: 61782 - DNA, 15 bp, Artificial Sequence
  dgRNA
  Tada3
ggggcgatttcacac

SEQ ID NO: 61783 - DNA, 15 bp, Artificial Sequence
  dgRNA
  Tada3
gggcgatttcacact

SEQ ID NO: 61784 - DNA, 15 bp, Artificial Sequence
  dgRNA
  Dmpk
gggatagtcagggac

SEQ ID NO: 61785 - DNA, 15 bp, Artificial Sequence
  dgRNA
  Scnn1b
accctgtatagagac

SEQ ID NO: 61786 - DNA, 15 bp, Artificial Sequence
  dgRNA
  Scnn1b
ccctgtatagagact

SEQ ID NO: 61787 - DNA, 15 bp, Artificial Sequence
  dgRNA
  Scnn1b
tcccgcaagccctcc

SEQ ID NO: 61788 - DNA, 15 bp, Artificial Sequence
  dgRNA
  Scnn1b
gcaagccctcccggt

SEQ ID NO: 61789 - DNA, 15 bp, Artificial Sequence
  dgRNA
  Plekha4
aaaggctgtcccggc

SEQ ID NO: 61790 - DNA, 15 bp, Artificial Sequence
  dgRNA
  Plekha4
tgtcccggccggcaa

SEQ ID NO: 61791 - DNA, 15 bp, Artificial Sequence
  dgRNA
  Plekha4
gtcccggccggcaaa

SEQ ID NO: 61792 - DNA, 15 bp, Artificial Sequence
  dgRNA
  Plekha4
gccggcaaagggatg

SEQ ID NO: 61793 - DNA, 15 bp, Artificial Sequence
  dgRNA
  Coa6
aacggagcttggtgc

SEQ ID NO: 61794 - DNA, 15 bp, Artificial Sequence
  dgRNA
  Coa6
agcttggtgccggct

SEQ ID NO: 61795 - DNA, 15 bp, Artificial Sequence
  dgRNA
  Coa6
cgcctccgccaattc

SEQ ID NO: 61796 - DNA, 15 bp, Artificial Sequence
  dgRNA
  Coa6
gcctccgccaattcc

SEQ ID NO: 61797 - DNA, 15 bp, Artificial Sequence
  dgRNA
  Hps4
ttcgccgtccgcctc

SEQ ID NO: 61798 - DNA, 15 bp, Artificial Sequence
  dgRNA
  Hps4
cgtccgcctccggct

SEQ ID NO: 61799 - DNA, 15 bp, Artificial Sequence
  dgRNA
  Hps4
gcctccggctcggcc

SEQ ID NO: 61800 - DNA, 15 bp, Artificial Sequence
  dgRNA
  Hps4
cctccggctcggccc

SEQ ID NO: 61801 - DNA, 15 bp, Artificial Sequence
  dgRNA
  Cnot6
cgggcaggagcgcgc

SEQ ID NO: 61802 - DNA, 15 bp, Artificial Sequence
  dgRNA
  Cnot6
gggcaggagcgcgcc

SEQ ID NO: 61803 - DNA, 15 bp, Artificial Sequence
  dgRNA
  Cnot6
aggagcgcgccgggc

SEQ ID NO: 61804 - DNA, 15 bp, Artificial Sequence
  dgRNA
  Cnot6
tcactgctccgagac

SEQ ID NO: 61805 - DNA, 15 bp, Artificial Sequence
  dgRNA
  Apoc3
caagggatcagctac

SEQ ID NO: 61806 - DNA, 15 bp, Artificial Sequence
  dgRNA
  Cfap73
gatagcttccctttc

SEQ ID NO: 61807 - DNA, 15 bp, Artificial Sequence
  dgRNA
  Cfap73
caaccacggcttgct

SEQ ID NO: 61808 - DNA, 15 bp, Artificial Sequence
  dgRNA
  Cfap73
cggcttgctcggcct

SEQ ID NO: 61809 - DNA, 15 bp, Artificial Sequence
  dgRNA
  Cfap73
ggcttgctcggcctt

SEQ ID NO: 61810 - DNA, 15 bp, Artificial Sequence
  dgRNA
  Neo1
gcccctgcgccagct

SEQ ID NO: 61811 - DNA, 15 bp, Artificial Sequence
  dgRNA
  Neo1
tcggctccaccgccg

SEQ ID NO: 61812 - DNA, 15 bp, Artificial Sequence
  dgRNA
  Neo1
ccgcgaagcgaccgc

SEQ ID NO: 61813 - DNA, 15 bp, Artificial Sequence
  dgRNA
  Neo1
cgcgaagcgaccgcc

SEQ ID NO: 61814 - DNA, 15 bp, Artificial Sequence
  dgRNA
  Sarm1
ttgcacaccaccaag

SEQ ID NO: 61815 - DNA, 15 bp, Artificial Sequence
  dgRNA
  Sarm1
ggcggagccaggtgt

SEQ ID NO: 61816 - DNA, 15 bp, Artificial Sequence
  dgRNA
  Sarm1
cgtggctggagacct

SEQ ID NO: 61817 - DNA, 15 bp, Artificial Sequence
  dgRNA
  Sarm1
ggcttgcgcctgcgt

SEQ ID NO: 61818 - DNA, 15 bp, Artificial Sequence
  dgRNA
  Olfr1309
actgacccatctaag

SEQ ID NO: 61819 - DNA, 15 bp, Artificial Sequence
  dgRNA
  Olfr1309
tacctccacagttgc

SEQ ID NO: 61820 - DNA, 15 bp, Artificial Sequence
  dgRNA
  Olfr1309
agcttccacttagat

SEQ ID NO: 61821 - DNA, 15 bp, Artificial Sequence
  dgRNA
  Olfr1309
tagcttccacttaga

SEQ ID NO: 61822 - DNA, 15 bp, Artificial Sequence
  dgRNA
  Med11
ctggcattagcgccc

SEQ ID NO: 61823 - DNA, 15 bp, Artificial Sequence
  dgRNA
  Med11
cagtcagactagacc

SEQ ID NO: 61824 - DNA, 15 bp, Artificial Sequence
  dgRNA
  Med11
ccaggtagactcgga

SEQ ID NO: 61825 - DNA, 15 bp, Artificial Sequence
  dgRNA
  Med11
caggtagactcggaa

SEQ ID NO: 61826 - DNA, 15 bp, Artificial Sequence
  dgRNA
  Nipal4
gctggcatcccggaa

SEQ ID NO: 61827 - DNA, 15 bp, Artificial Sequence
  dgRNA
  Nipal4
ggcatcccggaaagg

SEQ ID NO: 61828 - DNA, 15 bp, Artificial Sequence
  dgRNA
  Nipal4
gcatcccggaaaggc

SEQ ID NO: 61829 - DNA, 15 bp, Artificial Sequence
  dgRNA
  Nipal4
ccggaaaggcgggcc

SEQ ID NO: 61830 - DNA, 15 bp, Artificial Sequence
  dgRNA
  Dhrs2
atctggggccataga

SEQ ID NO: 61831 - DNA, 15 bp, Artificial Sequence
  dgRNA
  Dhrs2
cctgaggtagttcta

SEQ ID NO: 61832 - DNA, 15 bp, Artificial Sequence
  dgRNA
  Dhrs2
gcgtgagtcatcaaa

SEQ ID NO: 61833 - DNA, 15 bp, Artificial Sequence
  dgRNA
  Dhrs2
cgtgagtcatcaaaa

SEQ ID NO: 61834 - DNA, 15 bp, Artificial Sequence
  dgRNA
  St6galnac6
gctggagctgcggcg

SEQ ID NO: 61835 - DNA, 15 bp, Artificial Sequence
  dgRNA
  St6galnac6
gctgcggcggggcct

SEQ ID NO: 61836 - DNA, 15 bp, Artificial Sequence
  dgRNA
  Ccser1
gccctggcgactcgc

SEQ ID NO: 61837 - DNA, 15 bp, Artificial Sequence
  dgRNA
  Ccser1
ccctggcgactcgca

SEQ ID NO: 61838 - DNA, 15 bp, Artificial Sequence
  dgRNA
  Ccser1
gcgactcgcagggcg

SEQ ID NO: 61839 - DNA, 15 bp, Artificial Sequence
  dgRNA
  Ccser1
cgactcgcagggcgc

SEQ ID NO: 61840 - DNA, 15 bp, Artificial Sequence
  dgRNA
  Eaf2
cagcgtacctcagcg

SEQ ID NO: 61841 - DNA, 15 bp, Artificial Sequence
  dgRNA
  Eaf2
cgtacctcagcgagg

SEQ ID NO: 61842 - DNA, 15 bp, Artificial Sequence
  dgRNA
  Eaf2
gtgtgcgtcgcgacg

SEQ ID NO: 61843 - DNA, 15 bp, Artificial Sequence
  dgRNA
  Eaf2
tgtgcgtcgcgacgc

SEQ ID NO: 61844 - DNA, 15 bp, Artificial Sequence
  dgRNA
  Gucy2d
gacaccacacagacg

SEQ ID NO: 61845 - DNA, 15 bp, Artificial Sequence
  dgRNA
  Gucy2d
atctgttcagacacc

SEQ ID NO: 61846 - DNA, 15 bp, Artificial Sequence
  dgRNA
  Gucy2d
cgagactcctgcctg

SEQ ID NO: 61847 - DNA, 15 bp, Artificial Sequence
  dgRNA
  Gucy2d
cccgagactcctgcc

SEQ ID NO: 61848 - DNA, 15 bp, Artificial Sequence
  dgRNA
  Adrbk2
tgggtcaggagcgcg

SEQ ID NO: 61849 - DNA, 15 bp, Artificial Sequence
  dgRNA
  Adrbk2
aggagcgcgtggccg

SEQ ID NO: 61850 - DNA, 15 bp, Artificial Sequence
  dgRNA
  Adrbk2
gcgcgtggccgcgga

SEQ ID NO: 61851 - DNA, 15 bp, Artificial Sequence
  dgRNA
  Adrbk2
gtggccgcggacggt

SEQ ID NO: 61852 - DNA, 15 bp, Artificial Sequence
  dgRNA
  Chd1
cgccaggggtagcgc

SEQ ID NO: 61853 - DNA, 15 bp, Artificial Sequence
  dgRNA
  Chd1
cggttacgagtgcga

SEQ ID NO: 61854 - DNA, 15 bp, Artificial Sequence
  dgRNA
  Chd1
gcgaaggccgagcct

SEQ ID NO: 61855 - DNA, 15 bp, Artificial Sequence
  dgRNA
  Chd1
cggtggctttccccg

SEQ ID NO: 61856 - DNA, 15 bp, Artificial Sequence
  dgRNA
  Prdm11
gcgtcgccctccccg

SEQ ID NO: 61857 - DNA, 15 bp, Artificial Sequence
  dgRNA
  Prdm11
cgtcgccctccccgt

SEQ ID NO: 61858 - DNA, 15 bp, Artificial Sequence
  dgRNA
  Prdm11
gtcgccctccccgtg

SEQ ID NO: 61859 - DNA, 15 bp, Artificial Sequence
  dgRNA
  Prdm11
tccccgtggggcgcg

SEQ ID NO: 61860 - DNA, 15 bp, Artificial Sequence
  dgRNA
  Spock3
tttcaatttcaaggg

SEQ ID NO: 61861 - DNA, 15 bp, Artificial Sequence
  dgRNA
  Kcnk16
ccgcagacacctgtg

SEQ ID NO: 61862 - DNA, 15 bp, Artificial Sequence
  dgRNA
  Kcnk16
cagacacctgtgcgg

SEQ ID NO: 61863 - DNA, 15 bp, Artificial Sequence
  dgRNA
  Kcnk16
tgtgcggtggaggac

SEQ ID NO: 61864 - DNA, 15 bp, Artificial Sequence
  dgRNA
  Kcnk16
acaggtgtctgcggc

SEQ ID NO: 61865 - DNA, 15 bp, Artificial Sequence
  dgRNA
  Mgst3
tcacgaaaagatact

SEQ ID NO: 61866 - DNA, 15 bp, Artificial Sequence
  dgRNA
  Mgst3
tatacactggggagc

SEQ ID NO: 61867 - DNA, 15 bp, Artificial Sequence
  dgRNA
  Mgst3
cgggctacccgacac

SEQ ID NO: 61868 - DNA, 15 bp, Artificial Sequence
  dgRNA
  Mgst3
gggctacccgacaca

SEQ ID NO: 61869 - DNA, 15 bp, Artificial Sequence
  dgRNA
  Vmn1r89
gtttgttaagtctag

SEQ ID NO: 61870 - DNA, 15 bp, Artificial Sequence
  dgRNA
  Krtap28-13
ggggagcagtataaa

SEQ ID NO: 61871 - DNA, 15 bp, Artificial Sequence
  dgRNA
  Olfr1212
cacggaacaattagc

SEQ ID NO: 61872 - DNA, 15 bp, Artificial Sequence
  dgRNA
  Dnase1l3
cgcaggattgctgtc

SEQ ID NO: 61873 - DNA, 15 bp, Artificial Sequence
  dgRNA
  Dnase1l3
agctgcgtcagacac

SEQ ID NO: 61874 - DNA, 15 bp, Artificial Sequence
  dgRNA
  Dnase1l3
tcgtgtgacccaaac

SEQ ID NO: 61875 - DNA, 15 bp, Artificial Sequence
  dgRNA
  Cdx2
tattcagctgtgatc

SEQ ID NO: 61876 - DNA, 15 bp, Artificial Sequence
  dgRNA
  Cdx2
ggtcgctgccctctc

SEQ ID NO: 61877 - DNA, 15 bp, Artificial Sequence
  dgRNA
  Cdx2
tgcaaatcgtgtttc

SEQ ID NO: 61878 - DNA, 15 bp, Artificial Sequence
  dgRNA
  Cdx2
gcaaatcgtgtttct

SEQ ID NO: 61879 - DNA, 15 bp, Artificial Sequence
  dgRNA
  Snap47
ccaaatagggaccgg

SEQ ID NO: 61880 - DNA, 15 bp, Artificial Sequence
  dgRNA
  Snap47
cccctaaaatcagct

SEQ ID NO: 61881 - DNA, 15 bp, Artificial Sequence
  dgRNA
  Snap47
aaaatcagctcggag

SEQ ID NO: 61882 - DNA, 15 bp, Artificial Sequence
  dgRNA
  Snap47
ggaacgaaaagccac

SEQ ID NO: 61883 - DNA, 15 bp, Artificial Sequence
  dgRNA
  Rnd2
gaactcaaataaacg

SEQ ID NO: 61884 - DNA, 15 bp, Artificial Sequence
  dgRNA
  Rnd2
ataaacggggctcgc

SEQ ID NO: 61885 - DNA, 15 bp, Artificial Sequence
  dgRNA
  Rnd2
accctcaggcgctcc

SEQ ID NO: 61886 - DNA, 15 bp, Artificial Sequence
  dgRNA
  Rnd2
cctcaggcgctcctg

SEQ ID NO: 61887 - DNA, 15 bp, Artificial Sequence
  dgRNA
  Chmp6
gcggttttgaaagtc

SEQ ID NO: 61888 - DNA, 15 bp, Artificial Sequence
  dgRNA
  Chmp6
ttagctgaaaggccg

SEQ ID NO: 61889 - DNA, 15 bp, Artificial Sequence
  dgRNA
  Chmp6
tagctgaaaggccga

SEQ ID NO: 61890 - DNA, 15 bp, Artificial Sequence
  dgRNA
  Chmp6
gcggtgcgctgcgct

SEQ ID NO: 61891 - DNA, 15 bp, Artificial Sequence
  dgRNA
  Cdk1
acaacaggacgatat

SEQ ID NO: 61892 - DNA, 15 bp, Artificial Sequence
  dgRNA
  Cdk1
caggacgatattgga

SEQ ID NO: 61893 - DNA, 15 bp, Artificial Sequence
  dgRNA
  Cdk1
caattcctctggccg

SEQ ID NO: 61894 - DNA, 15 bp, Artificial Sequence
  dgRNA
  Cdk1
gcgctctgcgctccc

SEQ ID NO: 61895 - DNA, 15 bp, Artificial Sequence
  dgRNA
  Tmod4
tgtcatggctgatac

SEQ ID NO: 61896 - DNA, 15 bp, Artificial Sequence
  dgRNA
  Tmod4
gatactggccactag

SEQ ID NO: 61897 - DNA, 15 bp, Artificial Sequence
  dgRNA
  Tmod4
cactagaggctctca

SEQ ID NO: 61898 - DNA, 15 bp, Artificial Sequence
  dgRNA
  Tmod4
atgactcctacggta

SEQ ID NO: 61899 - DNA, 15 bp, Artificial Sequence
  dgRNA
  Tph1
agtagctaactagcc

SEQ ID NO: 61900 - DNA, 15 bp, Artificial Sequence
  dgRNA
  Tph1
gtgaatactttgatg

SEQ ID NO: 61901 - DNA, 15 bp, Artificial Sequence
  dgRNA
  Ncaph2
cgtatgacgtcaggc

SEQ ID NO: 61902 - DNA, 15 bp, Artificial Sequence
  dgRNA
  Ncaph2
acgtatgacgtcagg

SEQ ID NO: 61903 - DNA, 15 bp, Artificial Sequence
  dgRNA
  Ncaph2
cacacgtatgacgtc

SEQ ID NO: 61904 - DNA, 15 bp, Artificial Sequence
  dgRNA
  Mt1
ttaccacgctgcgaa

SEQ ID NO: 61905 - DNA, 15 bp, Artificial Sequence
  dgRNA
  Mt1
taccacgctgcgaat

SEQ ID NO: 61906 - DNA, 15 bp, Artificial Sequence
  dgRNA
  Mt1
ctgcgaatgggttta

SEQ ID NO: 61907 - DNA, 15 bp, Artificial Sequence
  dgRNA
  Mt1
gtttacggagatagc

SEQ ID NO: 61908 - DNA, 15 bp, Artificial Sequence
  dgRNA
  Usp19
tctcgattccggttc

SEQ ID NO: 61909 - DNA, 15 bp, Artificial Sequence
  dgRNA
  Usp19
acacgctctcgattc

SEQ ID NO: 61910 - DNA, 15 bp, Artificial Sequence
  dgRNA
  Srsf6
tggctgcacagcgcc

SEQ ID NO: 61911 - DNA, 15 bp, Artificial Sequence
  dgRNA
  Srsf6
gctgcacagcgccag

SEQ ID NO: 61912 - DNA, 15 bp, Artificial Sequence
  dgRNA
  Srsf6
gcacggcacgcgccg

SEQ ID NO: 61913 - DNA, 15 bp, Artificial Sequence
  dgRNA
  Srsf6
cacggcacgcgccgc

SEQ ID NO: 61914 - DNA, 15 bp, Artificial Sequence
  dgRNA
  Otud4
cgtttcctcggttct

SEQ ID NO: 61915 - DNA, 15 bp, Artificial Sequence
  dgRNA
  Otud4
cctcggttctcggcg

SEQ ID NO: 61916 - DNA, 15 bp, Artificial Sequence
  dgRNA
  Otud4
ctcggttctcggcgt

SEQ ID NO: 61917 - DNA, 15 bp, Artificial Sequence
  dgRNA
  Otud4
tcggttctcggcgtg

SEQ ID NO: 61918 - DNA, 15 bp, Artificial Sequence
  dgRNA
  Hnrnpul2
accgcaccacagcgg

SEQ ID NO: 61919 - DNA, 15 bp, Artificial Sequence
  dgRNA
  Hnrnpul2
agcggaggcccaagc

SEQ ID NO: 61920 - DNA, 15 bp, Artificial Sequence
  dgRNA
  Hnrnpul2
ttcggtttaagttgc

SEQ ID NO: 61921 - DNA, 15 bp, Artificial Sequence
  dgRNA
  Hnrnpul2
cagtttagcctctaa

SEQ ID NO: 61922 - DNA, 15 bp, Artificial Sequence
  dgRNA
  Slc9b2
taacctagcacgcct

SEQ ID NO: 61923 - DNA, 15 bp, Artificial Sequence
  dgRNA
  Slc9b2
cgccttggtaaacct

SEQ ID NO: 61924 - DNA, 15 bp, Artificial Sequence
  dgRNA
  Slc9b2
ccagtggcgcggggc

SEQ ID NO: 61925 - DNA, 15 bp, Artificial Sequence
  dgRNA
  Slc9b2
tccagtggcgcgggg

SEQ ID NO: 61926 - DNA, 15 bp, Artificial Sequence
  dgRNA
  Dis3l
gctgcctgcccgacc

SEQ ID NO: 61927 - DNA, 15 bp, Artificial Sequence
  dgRNA
  Dis3l
gcccgaccaggcccg

SEQ ID NO: 61928 - DNA, 15 bp, Artificial Sequence
  dgRNA
  Dis3l
cccgaccaggcccga

SEQ ID NO: 61929 - DNA, 15 bp, Artificial Sequence
  dgRNA
  Dis3l
ccgaccaggcccgag

SEQ ID NO: 61930 - DNA, 15 bp, Artificial Sequence
  dgRNA
  Mospd1
ggctagaccccgccc

SEQ ID NO: 61931 - DNA, 15 bp, Artificial Sequence
  dgRNA
  Mospd1
gctagaccccgcccc

SEQ ID NO: 61932 - DNA, 15 bp, Artificial Sequence
  dgRNA
  Mospd1
tgcgactcatcctcc

SEQ ID NO: 61933 - DNA, 15 bp, Artificial Sequence
  dgRNA
  Mospd1
gcgactcatcctcct

SEQ ID NO: 61934 - DNA, 15 bp, Artificial Sequence
  dgRNA
  Serp2
gcagcgttcgatctc

SEQ ID NO: 61935 - DNA, 15 bp, Artificial Sequence
  dgRNA
  Serp2
ttcgatctcaggacc

SEQ ID NO: 61936 - DNA, 15 bp, Artificial Sequence
  dgRNA
  Serp2
aggacccggacaccc

SEQ ID NO: 61937 - DNA, 15 bp, Artificial Sequence
  dgRNA
  Serp2
ggacccggacacccc

SEQ ID NO: 61938 - DNA, 15 bp, Artificial Sequence
  dgRNA
  Abcg4
cttgagcccttagag

SEQ ID NO: 61939 - DNA, 15 bp, Artificial Sequence
  dgRNA
  Abcg4
ttgagcccttagaga

SEQ ID NO: 61940 - DNA, 15 bp, Artificial Sequence
  dgRNA
  Abcg4
tgagcccttagagag

SEQ ID NO: 61941 - DNA, 15 bp, Artificial Sequence
  dgRNA
  Abcg4
gtgaagaggcgtgag

SEQ ID NO: 61942 - DNA, 15 bp, Artificial Sequence
  dgRNA
  Slc41a3
cttgcagtgtgctac

SEQ ID NO: 61943 - DNA, 15 bp, Artificial Sequence
  dgRNA
  Slc41a3
accccgccctactca

SEQ ID NO: 61944 - DNA, 15 bp, Artificial Sequence
  dgRNA
  Slc41a3
catggtcctgttccg

SEQ ID NO: 61945 - DNA, 15 bp, Artificial Sequence
  dgRNA
  Slc41a3
gcggcaccgcctctg

SEQ ID NO: 61946 - DNA, 15 bp, Artificial Sequence
  dgRNA
  Serpina12
tgcaaaaggtatgag

SEQ ID NO: 61947 - DNA, 15 bp, Artificial Sequence
  dgRNA
  Serpina12
gagtggcctgcgttg

SEQ ID NO: 61948 - DNA, 15 bp, Artificial Sequence
  dgRNA
  Serpina12
aggtagctcccgccc

SEQ ID NO: 61949 - DNA, 15 bp, Artificial Sequence
  dgRNA
  Serpina12
ggtagctcccgccca

SEQ ID NO: 61950 - DNA, 15 bp, Artificial Sequence
  dgRNA
  Ugt1a7c
gcgtagatttctctc

SEQ ID NO: 61951 - DNA, 15 bp, Artificial Sequence
  dgRNA
  Ugt1a7c
atacactaaacccta

SEQ ID NO: 61952 - DNA, 15 bp, Artificial Sequence
  dgRNA
  Ugt1a7c
gagcaagcatgatta

SEQ ID NO: 61953 - DNA, 15 bp, Artificial Sequence
  dgRNA
  Ugt1a7c
tgctcacagccgttt

SEQ ID NO: 61954 - DNA, 15 bp, Artificial Sequence
  dgRNA
  Dlx5
tgtgctaaaactagt

SEQ ID NO: 61955 - DNA, 15 bp, Artificial Sequence
  dgRNA
  Dlx5
ctagttggacgagtt

SEQ ID NO: 61956 - DNA, 15 bp, Artificial Sequence
  dgRNA
  Dlx5
tagttggacgagtta

SEQ ID NO: 61957 - DNA, 15 bp, Artificial Sequence
  dgRNA
  Dlx5
cgaagccctggccaa

SEQ ID NO: 61958 - DNA, 15 bp, Artificial Sequence
  dgRNA
  Nup37
agcccgaatgcccac

SEQ ID NO: 61959 - DNA, 15 bp, Artificial Sequence
  dgRNA
  Nup37
actggaactgcgacc

SEQ ID NO: 61960 - DNA, 15 bp, Artificial Sequence
  dgRNA
  Nup37
ctggaactgcgaccc

SEQ ID NO: 61961 - DNA, 15 bp, Artificial Sequence
  dgRNA
  Nup37
tggaactgcgacccg

SEQ ID NO: 61962 - DNA, 15 bp, Artificial Sequence
  dgRNA
  Matr3
aagcatcttttagag

SEQ ID NO: 61963 - DNA, 15 bp, Artificial Sequence
  dgRNA
  Matr3
cttttagagaggtac

SEQ ID NO: 61964 - DNA, 15 bp, Artificial Sequence
  dgRNA
  Matr3
ggtacaggaacgggt

SEQ ID NO: 61965 - DNA, 15 bp, Artificial Sequence
  dgRNA
  Matr3
cccgccttcgcctga

SEQ ID NO: 61966 - DNA, 15 bp, Artificial Sequence
  dgRNA
  Pm20d1
tgccagaacaagagc

SEQ ID NO: 61967 - DNA, 15 bp, Artificial Sequence
  dgRNA
  Pm20d1
ctgacccttgtctag

SEQ ID NO: 61968 - DNA, 15 bp, Artificial Sequence
  dgRNA
  Pm20d1
tgacccttgtctaga

SEQ ID NO: 61969 - DNA, 15 bp, Artificial Sequence
  dgRNA
  Pm20d1
ggtcgctcgattgat

SEQ ID NO: 61970 - DNA, 15 bp, Artificial Sequence
  dgRNA
  1700016K19Rik
ttgatcacgcattag

SEQ ID NO: 61971 - DNA, 15 bp, Artificial Sequence
  dgRNA
  1700016K19Rik
tcacgcattagtgga

SEQ ID NO: 61972 - DNA, 15 bp, Artificial Sequence
  dgRNA
  1700016K19Rik
cacgcattagtggat

SEQ ID NO: 61973 - DNA, 15 bp, Artificial Sequence
  dgRNA
  1700016K19Rik
gcgcttcaactcacc

SEQ ID NO: 61974 - DNA, 15 bp, Artificial Sequence
  dgRNA
  Sulf1
gaaattcacccccag

SEQ ID NO: 61975 - DNA, 15 bp, Artificial Sequence
  dgRNA
  Sulf1
atgataataatacgc

SEQ ID NO: 61976 - DNA, 15 bp, Artificial Sequence
  dgRNA
  Sulf1
tgataataatacgcc

SEQ ID NO: 61977 - DNA, 15 bp, Artificial Sequence
  dgRNA
  Sulf1
gtccctaatgaatct

SEQ ID NO: 61978 - DNA, 15 bp, Artificial Sequence
  dgRNA
  Pck2
gcattcgacatctct

SEQ ID NO: 61979 - DNA, 15 bp, Artificial Sequence
  dgRNA
  Pck2
cagtatcttacagcg

SEQ ID NO: 61980 - DNA, 15 bp, Artificial Sequence
  dgRNA
  Pck2
atcttacagcgtggc

SEQ ID NO: 61981 - DNA, 15 bp, Artificial Sequence
  dgRNA
  Pck2
gcgtggctggccgag

SEQ ID NO: 61982 - DNA, 15 bp, Artificial Sequence
  dgRNA
  Dusp19
cgaggggcagcccct

SEQ ID NO: 61983 - DNA, 15 bp, Artificial Sequence
  dgRNA
  Dusp19
tgggaaaaggccgtg

SEQ ID NO: 61984 - DNA, 15 bp, Artificial Sequence
  dgRNA
  Dusp19
gtgttagactggtta

SEQ ID NO: 61985 - DNA, 15 bp, Artificial Sequence
  dgRNA
  Dusp19
ctggaagtgttagac

SEQ ID NO: 61986 - DNA, 15 bp, Artificial Sequence
  dgRNA
  Fam43a
ggtaaatttggaacg

SEQ ID NO: 61987 - DNA, 15 bp, Artificial Sequence
  dgRNA
  Fam43a
acgtggttgcctaag

SEQ ID NO: 61988 - DNA, 15 bp, Artificial Sequence
  dgRNA
  Fam43a
gaccagaactgcgtc

SEQ ID NO: 61989 - DNA, 15 bp, Artificial Sequence
  dgRNA
  Fam43a
gcgtcgcagccctaa

SEQ ID NO: 61990 - DNA, 15 bp, Artificial Sequence
  dgRNA
  Dao
gcctttggcccacgg

SEQ ID NO: 61991 - DNA, 15 bp, Artificial Sequence
  dgRNA
  Dao
caaggggcgggtgtt

SEQ ID NO: 61992 - DNA, 15 bp, Artificial Sequence
  dgRNA
  Dao
gtgggccaaaggcac

SEQ ID NO: 61993 - DNA, 15 bp, Artificial Sequence
  dgRNA
  Dao
gccaccgtgggccaa

SEQ ID NO: 61994 - DNA, 15 bp, Artificial Sequence
  dgRNA
  Olfr1428
caagtcttcaatttt

SEQ ID NO: 61995 - DNA, 15 bp, Artificial Sequence
  dgRNA
  Olfr1428
catcattatgttaca

SEQ ID NO: 61996 - DNA, 15 bp, Artificial Sequence
  dgRNA
  Olfr1428
cacatctacctaggg

SEQ ID NO: 61997 - DNA, 15 bp, Artificial Sequence
  dgRNA
  Ncoa2
ccaccgacccgaatc

SEQ ID NO: 61998 - DNA, 15 bp, Artificial Sequence
  dgRNA
  Ncoa2
gtaccggtaagccaa

SEQ ID NO: 61999 - DNA, 15 bp, Artificial Sequence
  dgRNA
  Ncoa2
ccggtaagccaatgg

SEQ ID NO: 62000 - DNA, 15 bp, Artificial Sequence
  dgRNA
  Ncoa2
cggtaagccaatggt

SEQ ID NO: 62001 - DNA, 15 bp, Artificial Sequence
  dgRNA
  4931440F15Rik
agccggcccatgtag

SEQ ID NO: 62002 - DNA, 15 bp, Artificial Sequence
  dgRNA
  Nkx2-5
attttcaggctaacg

SEQ ID NO: 62003 - DNA, 15 bp, Artificial Sequence
  dgRNA
  Nkx2-5
atcccaaatgtgtcg

SEQ ID NO: 62004 - DNA, 15 bp, Artificial Sequence
  dgRNA
  Nkx2-5
ccctatgtctatatt

SEQ ID NO: 62005 - DNA, 15 bp, Artificial Sequence
  dgRNA
  Nkx2-5
tcgctcctgtcatcc

SEQ ID NO: 62006 - DNA, 15 bp, Artificial Sequence
  dgRNA
  Rpl13a
cgccccgcacagtca

SEQ ID NO: 62007 - DNA, 15 bp, Artificial Sequence
  dgRNA
  Rpl13a
gccaagagccaactc

SEQ ID NO: 62008 - DNA, 15 bp, Artificial Sequence
  dgRNA
  Rpl13a
aggcgacattctgat

SEQ ID NO: 62009 - DNA, 15 bp, Artificial Sequence
  dgRNA
  Rpl13a
cgaccaattagaaga

SEQ ID NO: 62010 - DNA, 15 bp, Artificial Sequence
  dgRNA
  Bcl3
agagctcccggccag

SEQ ID NO: 62011 - DNA, 15 bp, Artificial Sequence
  dgRNA
  Bcl3
tccgcctccgagacg

SEQ ID NO: 62012 - DNA, 15 bp, Artificial Sequence
  dgRNA
  Bcl3
ccgcctccgagacgc

SEQ ID NO: 62013 - DNA, 15 bp, Artificial Sequence
  dgRNA
  Bcl3
ccgagacgcgggtcc

SEQ ID NO: 62014 - DNA, 15 bp, Artificial Sequence
  dgRNA
  Zkscan8
gtcacctgaagcccg

SEQ ID NO: 62015 - DNA, 15 bp, Artificial Sequence
  dgRNA
  Zkscan8
cctgaagcccgaggc

SEQ ID NO: 62016 - DNA, 15 bp, Artificial Sequence
  dgRNA
  Zkscan8
gctatgtcactcctc

SEQ ID NO: 62017 - DNA, 15 bp, Artificial Sequence
  dgRNA
  Zkscan8
tagccgccctccacc

SEQ ID NO: 62018 - DNA, 15 bp, Artificial Sequence
  dgRNA
  Nrm
ttatgtttccacgca

SEQ ID NO: 62019 - DNA, 15 bp, Artificial Sequence
  dgRNA
  Nrm
tatgtttccacgcaa

SEQ ID NO: 62020 - DNA, 15 bp, Artificial Sequence
  dgRNA
  Nrm
gtttccacgcaaggg

SEQ ID NO: 62021 - DNA, 15 bp, Artificial Sequence
  dgRNA
  Nrm
gagattcgacccaca

SEQ ID NO: 62022 - DNA, 15 bp, Artificial Sequence
  dgRNA
  Tnfrsf1b
tcccggaagagatgc

SEQ ID NO: 62023 - DNA, 15 bp, Artificial Sequence
  dgRNA
  Tnfrsf1b
tggaggtgtcctgcg

SEQ ID NO: 62024 - DNA, 15 bp, Artificial Sequence
  dgRNA
  Tnfrsf1b
ggaggtgtcctgcga

SEQ ID NO: 62025 - DNA, 15 bp, Artificial Sequence
  dgRNA
  Tnfrsf1b
gaggtgtcctgcgag

SEQ ID NO: 62026 - DNA, 15 bp, Artificial Sequence
  dgRNA
  Tnfsfm13
agttggggggaattc

SEQ ID NO: 62027 - DNA, 15 bp, Artificial Sequence
  dgRNA
  Tnfsfm13
ataggcaagcccttt

SEQ ID NO: 62028 - DNA, 15 bp, Artificial Sequence
  dgRNA
  Tnfsfm13
taggcaagccctttg

SEQ ID NO: 62029 - DNA, 15 bp, Artificial Sequence
  dgRNA
  Tnfsfm13
gagggctcaacatac

SEQ ID NO: 62030 - DNA, 15 bp, Artificial Sequence
  dgRNA
  Coa3
gtctttcggagtact

SEQ ID NO: 62031 - DNA, 15 bp, Artificial Sequence
  dgRNA
  Coa3
tacttggacagttta

SEQ ID NO: 62032 - DNA, 15 bp, Artificial Sequence
  dgRNA
  Coa3
caccacggcttcgaa

SEQ ID NO: 62033 - DNA, 15 bp, Artificial Sequence
  dgRNA
  Coa3
aaggaggccagttta

SEQ ID NO: 62034 - DNA, 15 bp, Artificial Sequence
  dgRNA
  Dnajc28
aaattacatacacgt

SEQ ID NO: 62035 - DNA, 15 bp, Artificial Sequence
  dgRNA
  Dnajc28
aattacatacacgtt

SEQ ID NO: 62036 - DNA, 15 bp, Artificial Sequence
  dgRNA
  Dnajc28
attacatacacgttg

SEQ ID NO: 62037 - DNA, 15 bp, Artificial Sequence
  dgRNA
  Dnajc28
ccctgccctcgaaag

SEQ ID NO: 62038 - DNA, 15 bp, Artificial Sequence
  dgRNA
  Rcan1
attggtctgctctat

SEQ ID NO: 62039 - DNA, 15 bp, Artificial Sequence
  dgRNA
  Rcan1
acttgatggcccgag

SEQ ID NO: 62040 - DNA, 15 bp, Artificial Sequence
  dgRNA
  Rcan1
cttgatggcccgagt

SEQ ID NO: 62041 - DNA, 15 bp, Artificial Sequence
  dgRNA
  Rcan1
gtgggccgaccttaa

SEQ ID NO: 62042 - DNA, 15 bp, Artificial Sequence
  dgRNA
  Rab6a
gcgacgcaaggcgat

SEQ ID NO: 62043 - DNA, 15 bp, Artificial Sequence
  dgRNA
  Rab6a
gtgtggcgcgacgca

SEQ ID NO: 62044 - DNA, 15 bp, Artificial Sequence
  dgRNA
  Rab6a
cgcggaggaaggtgt

SEQ ID NO: 62045 - DNA, 15 bp, Artificial Sequence
  dgRNA
  Rab6a
gcgcggaggaaggtg

SEQ ID NO: 62046 - DNA, 15 bp, Artificial Sequence
  dgRNA
  Fam169a
gtagctttgcaagtc

SEQ ID NO: 62047 - DNA, 15 bp, Artificial Sequence
  dgRNA
  Fam169a
acttagcctttagtc

SEQ ID NO: 62048 - DNA, 15 bp, Artificial Sequence
  dgRNA
  Fam169a
tagcctttagtccgg

SEQ ID NO: 62049 - DNA, 15 bp, Artificial Sequence
  dgRNA
  Fam169a
aaacctccggactaa

SEQ ID NO: 62050 - DNA, 15 bp, Artificial Sequence
  dgRNA
  Asic1
ctcgcagacactcgt

SEQ ID NO: 62051 - DNA, 15 bp, Artificial Sequence
  dgRNA
  Asic1
ctcccggccggacga

SEQ ID NO: 62052 - DNA, 15 bp, Artificial Sequence
  dgRNA
  Asic1
cagcgcgccgagccc

SEQ ID NO: 62053 - DNA, 15 bp, Artificial Sequence
  dgRNA
  Asic1
agcgcgccgagcccc

SEQ ID NO: 62054 - DNA, 15 bp, Artificial Sequence
  dgRNA
  Slpi
taacccttttgtgac

SEQ ID NO: 62055 - DNA, 15 bp, Artificial Sequence
  dgRNA
  Slpi
tgagagcaatagtct

SEQ ID NO: 62056 - DNA, 15 bp, Artificial Sequence
  dgRNA
  Slpi
gagagcaatagtctt

SEQ ID NO: 62057 - DNA, 15 bp, Artificial Sequence
  dgRNA
  Slpi
gatttcacaatgctc

SEQ ID NO: 62058 - DNA, 15 bp, Artificial Sequence
  dgRNA
  Ngf
aggacccttacaacc

SEQ ID NO: 62059 - DNA, 15 bp, Artificial Sequence
  dgRNA
  Ngf
tacaacccggacccc

SEQ ID NO: 62060 - DNA, 15 bp, Artificial Sequence
  dgRNA
  Ngf
acaacccggacccct

SEQ ID NO: 62061 - DNA, 15 bp, Artificial Sequence
  dgRNA
  Ngf
gggtctagtcacagc

SEQ ID NO: 62062 - DNA, 15 bp, Artificial Sequence
  dgRNA
  Rb1cc1
aggtcacgctcacct

SEQ ID NO: 62063 - DNA, 15 bp, Artificial Sequence
  dgRNA
  Rb1cc1
ggtcacgctcacctt

SEQ ID NO: 62064 - DNA, 15 bp, Artificial Sequence
  dgRNA
  Rb1cc1
gtcacgctcaccttg

SEQ ID NO: 62065 - DNA, 15 bp, Artificial Sequence
  dgRNA
  Rb1cc1
ccgaaataccttcca

SEQ ID NO: 62066 - DNA, 15 bp, Artificial Sequence
  dgRNA
  Cyp2f2
gacagagggttctag

SEQ ID NO: 62067 - DNA, 15 bp, Artificial Sequence
  dgRNA
  Cyp2f2
caaggtctatagaca

SEQ ID NO: 62068 - DNA, 15 bp, Artificial Sequence
  dgRNA
  Cyp2f2
tagacaaggtatgct

SEQ ID NO: 62069 - DNA, 15 bp, Artificial Sequence
  dgRNA
  Cyp2f2
caaggtatgctagga

SEQ ID NO: 62070 - DNA, 15 bp, Artificial Sequence
  dgRNA
  Slamf6
gtgggctccccgtcc

SEQ ID NO: 62071 - DNA, 15 bp, Artificial Sequence
  dgRNA
  Slamf6
tccccgtcctggcat

SEQ ID NO: 62072 - DNA, 15 bp, Artificial Sequence
  dgRNA
  Slamf6
actcctgatactgtg

SEQ ID NO: 62073 - DNA, 15 bp, Artificial Sequence
  dgRNA
  Slamf6
acctatgccaggacg

SEQ ID NO: 62074 - DNA, 15 bp, Artificial Sequence
  dgRNA
  Gmfg
gccctctgggagatt

SEQ ID NO: 62075 - DNA, 15 bp, Artificial Sequence
  dgRNA
  Gmfg
acccaatctcccaga

SEQ ID NO: 62076 - DNA, 15 bp, Artificial Sequence
  dgRNA
  Gmfg
gacccaatctcccag

SEQ ID NO: 62077 - DNA, 15 bp, Artificial Sequence
  dgRNA
  Gmfg
attgagcttctcctc

SEQ ID NO: 62078 - DNA, 15 bp, Artificial Sequence
  dgRNA
  Hc
ccccatctttattac

SEQ ID NO: 62079 - DNA, 15 bp, Artificial Sequence
  dgRNA
  Hc
attactggacatgat

SEQ ID NO: 62080 - DNA, 15 bp, Artificial Sequence
  dgRNA
  Nr1i3
ggtcctacctacata

SEQ ID NO: 62081 - DNA, 15 bp, Artificial Sequence
  dgRNA
  Nr1i3
ctacatatggcaccg

SEQ ID NO: 62082 - DNA, 15 bp, Artificial Sequence
  dgRNA
  Nr1i3
accgaggatacctag

SEQ ID NO: 62083 - DNA, 15 bp, Artificial Sequence
  dgRNA
  Nr1i3
gtgccatatgtaggt

SEQ ID NO: 62084 - DNA, 15 bp, Artificial Sequence
  dgRNA
  Nxt2
cagccctcgtgcagt

SEQ ID NO: 62085 - DNA, 15 bp, Artificial Sequence
  dgRNA
  Nxt2
ccctcgtgcagttgg

SEQ ID NO: 62086 - DNA, 15 bp, Artificial Sequence
  dgRNA
  Nxt2
cgtgcagttggcggt

SEQ ID NO: 62087 - DNA, 15 bp, Artificial Sequence
  dgRNA
  Nxt2
ccccccgtttctcgt

SEQ ID NO: 62088 - DNA, 15 bp, Artificial Sequence
  dgRNA
  Polr1e
agattttggtgtgac

SEQ ID NO: 62089 - DNA, 15 bp, Artificial Sequence
  dgRNA
  Polr1e
gaggtccgagacgaa

SEQ ID NO: 62090 - DNA, 15 bp, Artificial Sequence
  dgRNA
  Polr1e
aggtccgagacgaaa

SEQ ID NO: 62091 - DNA, 15 bp, Artificial Sequence
  dgRNA
  Polr1e
ggtccgagacgaaag

SEQ ID NO: 62092 - DNA, 15 bp, Artificial Sequence
  dgRNA
  Olfr875
ctcaacctctcattc

SEQ ID NO: 62093 - DNA, 15 bp, Artificial Sequence
  dgRNA
  Olfr875
gcccttactgtgccc

SEQ ID NO: 62094 - DNA, 15 bp, Artificial Sequence
  dgRNA
  Olfr875
ggattccgttttcac

SEQ ID NO: 62095 - DNA, 15 bp, Artificial Sequence
  dgRNA
  Olfr875
gattccgttttcaca

SEQ ID NO: 62096 - DNA, 15 bp, Artificial Sequence
  dgRNA
  Klhl35
agtgcccattcctac

SEQ ID NO: 62097 - DNA, 15 bp, Artificial Sequence
  dgRNA
  Klhl35
cccaagtgggagtct

SEQ ID NO: 62098 - DNA, 15 bp, Artificial Sequence
  dgRNA
  Klhl35
cggtgttttgaaggt

SEQ ID NO: 62099 - DNA, 15 bp, Artificial Sequence
  dgRNA
  Klhl35
gctgcggtgttttga

SEQ ID NO: 62100 - DNA, 15 bp, Artificial Sequence
  dgRNA
  Lrrc10b
cagccgcacgcgcgt

SEQ ID NO: 62101 - DNA, 15 bp, Artificial Sequence
  dgRNA
  Lrrc10b
agccgcacgcgcgtc

SEQ ID NO: 62102 - DNA, 15 bp, Artificial Sequence
  dgRNA
  Lrrc10b
gccgcacgcgcgtcg

SEQ ID NO: 62103 - DNA, 15 bp, Artificial Sequence
  dgRNA
  Lrrc10b
ccgcacgcgcgtcgg

SEQ ID NO: 62104 - DNA, 15 bp, Artificial Sequence
  dgRNA
  Rsbn1
ctcctggtttgtcaa

SEQ ID NO: 62105 - DNA, 15 bp, Artificial Sequence
  dgRNA
  Rsbn1
cctcacaaaggctat

SEQ ID NO: 62106 - DNA, 15 bp, Artificial Sequence
  dgRNA
  Rsbn1
tatggagaccacctc

SEQ ID NO: 62107 - DNA, 15 bp, Artificial Sequence
  dgRNA
  Rsbn1
cgggcaagatgaagg

SEQ ID NO: 62108 - DNA, 15 bp, Artificial Sequence
  dgRNA
  Calca
ttcccgctaatttta

SEQ ID NO: 62109 - DNA, 15 bp, Artificial Sequence
  dgRNA
  Calca
tcccgctaattttaa

SEQ ID NO: 62110 - DNA, 15 bp, Artificial Sequence
  dgRNA
  Calca
cgctaattttaaggg

SEQ ID NO: 62111 - DNA, 15 bp, Artificial Sequence
  dgRNA
  Calca
gtgacgcaatctgtc

SEQ ID NO: 62112 - DNA, 15 bp, Artificial Sequence
  dgRNA
  Parp14
aaactatcctagtga

SEQ ID NO: 62113 - DNA, 15 bp, Artificial Sequence
  dgRNA
  Parp14
aggctagagctcggg

SEQ ID NO: 62114 - DNA, 15 bp, Artificial Sequence
  dgRNA
  Parp14
ctagagctcgggtgg

SEQ ID NO: 62115 - DNA, 15 bp, Artificial Sequence
  dgRNA
  Qrfp
cagtgtctgagcccg

SEQ ID NO: 62116 - DNA, 15 bp, Artificial Sequence
  dgRNA
  Qrfp
ccggtggagacatgg

SEQ ID NO: 62117 - DNA, 15 bp, Artificial Sequence
  dgRNA
  Qrfp
ttcccggtggagaca

SEQ ID NO: 62118 - DNA, 15 bp, Artificial Sequence
  dgRNA
  Qrfp
actggaggttcccgg

SEQ ID NO: 62119 - DNA, 15 bp, Artificial Sequence
  dgRNA
  Rmdn2
tgtaaagctctcact

SEQ ID NO: 62120 - DNA, 15 bp, Artificial Sequence
  dgRNA
  Nfat5
tagtgtacttactct

SEQ ID NO: 62121 - DNA, 15 bp, Artificial Sequence
  dgRNA
  Nfat5
tgttttcacctaggc

SEQ ID NO: 62122 - DNA, 15 bp, Artificial Sequence
  dgRNA
  Nfat5
gacgtgttttcacct

SEQ ID NO: 62123 - DNA, 15 bp, Artificial Sequence
  dgRNA
  Rapgef6
atcgggtagagctgt

SEQ ID NO: 62124 - DNA, 15 bp, Artificial Sequence
  dgRNA
  Rapgef6
tatcgggtagagctg

SEQ ID NO: 62125 - DNA, 15 bp, Artificial Sequence
  dgRNA
  Wnt5a
actcgcgcgcctcgc

SEQ ID NO: 62126 - DNA, 15 bp, Artificial Sequence
  dgRNA
  Wnt5a
cgcctcgctggtccc

SEQ ID NO: 62127 - DNA, 15 bp, Artificial Sequence
  dgRNA
  Wnt5a
gcctcgctggtccct

SEQ ID NO: 62128 - DNA, 15 bp, Artificial Sequence
  dgRNA
  Wnt5a
cgctcttctcgccca

SEQ ID NO: 62129 - DNA, 15 bp, Artificial Sequence
  dgRNA
  Acin1
ctcccctgctgcatc

SEQ ID NO: 62130 - DNA, 15 bp, Artificial Sequence
  dgRNA
  Acin1
gaggtctactggtac

SEQ ID NO: 62131 - DNA, 15 bp, Artificial Sequence
  dgRNA
  Acin1
agctaagaggtctac

SEQ ID NO: 62132 - DNA, 15 bp, Artificial Sequence
  dgRNA
  Acin1
gggccctgatgcagc

SEQ ID NO: 62133 - DNA, 15 bp, Artificial Sequence
  dgRNA
  Snap91
agcgctagagagacg

SEQ ID NO: 62134 - DNA, 15 bp, Artificial Sequence
  dgRNA
  Snap91
gctagagagacgcgg

SEQ ID NO: 62135 - DNA, 15 bp, Artificial Sequence
  dgRNA
  Snap91
cgtctctctagcgct

SEQ ID NO: 62136 - DNA, 15 bp, Artificial Sequence
  dgRNA
  Ccdc107
taatgtaggaacgct

SEQ ID NO: 62137 - DNA, 15 bp, Artificial Sequence
  dgRNA
  Ccdc107
tgtaggaacgctagg

SEQ ID NO: 62138 - DNA, 15 bp, Artificial Sequence
  dgRNA
  Ccdc107
gtaggaacgctaggt

SEQ ID NO: 62139 - DNA, 15 bp, Artificial Sequence
  dgRNA
  Ccdc107
aacgctaggtgggcg

SEQ ID NO: 62140 - DNA, 15 bp, Artificial Sequence
  dgRNA
  Mrps2
actcgcccatttaca

SEQ ID NO: 62141 - DNA, 15 bp, Artificial Sequence
  dgRNA
  Mrps2
tgcgggcgcagcgag

SEQ ID NO: 62142 - DNA, 15 bp, Artificial Sequence
  dgRNA
  Mrps2
gcgagcggtgcacag

SEQ ID NO: 62143 - DNA, 15 bp, Artificial Sequence
  dgRNA
  Mrps2
cggtgcacagcggag

SEQ ID NO: 62144 - DNA, 15 bp, Artificial Sequence
  dgRNA
  Mup4
taatctcatcaccta

SEQ ID NO: 62145 - DNA, 15 bp, Artificial Sequence
  dgRNA
  A630023A22Rik
tacagttgtctacta

SEQ ID NO: 62146 - DNA, 15 bp, Artificial Sequence
  dgRNA
  A630023A22Rik
acagttgtctactat

SEQ ID NO: 62147 - DNA, 15 bp, Artificial Sequence
  dgRNA
  A630023A22Rik
ctccaaagctcttac

SEQ ID NO: 62148 - DNA, 15 bp, Artificial Sequence
  dgRNA
  A630023A22Rik
agtagacaactgtac

SEQ ID NO: 62149 - DNA, 15 bp, Artificial Sequence
  dgRNA
  Kel
acaaggagcagacgc

SEQ ID NO: 62150 - DNA, 15 bp, Artificial Sequence
  dgRNA
  Kel
caaggagcagacgca

SEQ ID NO: 62151 - DNA, 15 bp, Artificial Sequence
  dgRNA
  Pdcd5
gtcctaggaatcatt

SEQ ID NO: 62152 - DNA, 15 bp, Artificial Sequence
  dgRNA
  Pdcd5
taggaatcattaggg

SEQ ID NO: 62153 - DNA, 15 bp, Artificial Sequence
  dgRNA
  Pdcd5
aggaatcattagggt

SEQ ID NO: 62154 - DNA, 15 bp, Artificial Sequence
  dgRNA
  Pdcd5
gcgcagttcagagcc

SEQ ID NO: 62155 - DNA, 15 bp, Artificial Sequence
  dgRNA
  Cbl
ccccgcccgtcccag

SEQ ID NO: 62156 - DNA, 15 bp, Artificial Sequence
  dgRNA
  Cbl
cccgcccgtcccagt

SEQ ID NO: 62157 - DNA, 15 bp, Artificial Sequence
  dgRNA
  Cbl
gtgggcgcggaaact

SEQ ID NO: 62158 - DNA, 15 bp, Artificial Sequence
  dgRNA
  Cbl
gcggaaacttggtcg

SEQ ID NO: 62159 - DNA, 15 bp, Artificial Sequence
  dgRNA
  Mnt
aaagcggaaacagcg

SEQ ID NO: 62160 - DNA, 15 bp, Artificial Sequence
  dgRNA
  Mnt
ccacgtgtgcgcgcg

SEQ ID NO: 62161 - DNA, 15 bp, Artificial Sequence
  dgRNA
  Mnt
gtgtgcgcgcgcggt

SEQ ID NO: 62162 - DNA, 15 bp, Artificial Sequence
  dgRNA
  Mnt
ctcagtgagacgccg

SEQ ID NO: 62163 - DNA, 15 bp, Artificial Sequence
  dgRNA
  Gzmf
gtcaatctgaagcag

SEQ ID NO: 62164 - DNA, 15 bp, Artificial Sequence
  dgRNA
  Gzmf
gatgccgaggacccc

SEQ ID NO: 62165 - DNA, 15 bp, Artificial Sequence
  dgRNA
  Gzmf
tggttgaggatgccg

SEQ ID NO: 62166 - DNA, 15 bp, Artificial Sequence
  dgRNA
  Gzmf
gaccaagagtgtaga

SEQ ID NO: 62167 - DNA, 15 bp, Artificial Sequence
  dgRNA
  Siglec1
aagatcatttatggt

SEQ ID NO: 62168 - DNA, 15 bp, Artificial Sequence
  dgRNA
  Siglec1
agatcatttatggtg

SEQ ID NO: 62169 - DNA, 15 bp, Artificial Sequence
  dgRNA
  Cacnb2
aagaacttttcggag

SEQ ID NO: 62170 - DNA, 15 bp, Artificial Sequence
  dgRNA
  Cacnb2
aacttttcggagtgg

SEQ ID NO: 62171 - DNA, 15 bp, Artificial Sequence
  dgRNA
  Cacnb2
ttttcggagtggcgg

SEQ ID NO: 62172 - DNA, 15 bp, Artificial Sequence
  dgRNA
  Cacnb2
gacgcgcctcccccc

SEQ ID NO: 62173 - DNA, 15 bp, Artificial Sequence
  dgRNA
  Itgb5
cgtaaactgaccgag

SEQ ID NO: 62174 - DNA, 15 bp, Artificial Sequence
  dgRNA
  Itgb5
aaactgaccgagtgg

SEQ ID NO: 62175 - DNA, 15 bp, Artificial Sequence
  dgRNA
  Itgb5
cactcggtcagttta

SEQ ID NO: 62176 - DNA, 15 bp, Artificial Sequence
  dgRNA
  Ndrg4
ggggtagagctccag

SEQ ID NO: 62177 - DNA, 15 bp, Artificial Sequence
  dgRNA
  Scml2
accacttctccacga

SEQ ID NO: 62178 - DNA, 15 bp, Artificial Sequence
  dgRNA
  Scml2
caaactcgttcatgc

SEQ ID NO: 62179 - DNA, 15 bp, Artificial Sequence
  dgRNA
  Scml2
gttcatgcaggttgc

SEQ ID NO: 62180 - DNA, 15 bp, Artificial Sequence
  dgRNA
  Scml2
cgcggcagcagtctt

SEQ ID NO: 62181 - DNA, 15 bp, Artificial Sequence
  dgRNA
  Slc31a2
ggcaaggtcaattac

SEQ ID NO: 62182 - DNA, 15 bp, Artificial Sequence
  dgRNA
  Slc31a2
caattacaggttgcc

SEQ ID NO: 62183 - DNA, 15 bp, Artificial Sequence
  dgRNA
  Slc31a2
ggttgcctgggccgc

SEQ ID NO: 62184 - DNA, 15 bp, Artificial Sequence
  dgRNA
  Slc31a2
gttgcctgggccgct

SEQ ID NO: 62185 - DNA, 15 bp, Artificial Sequence
  dgRNA
  Zfp866
gtgacgacttggtga

SEQ ID NO: 62186 - DNA, 15 bp, Artificial Sequence
  dgRNA
  Zfp866
cccacacttcggctt

SEQ ID NO: 62187 - DNA, 15 bp, Artificial Sequence
  dgRNA
  Zfp866
ctttggtagccaatc

SEQ ID NO: 62188 - DNA, 15 bp, Artificial Sequence
  dgRNA
  Zfp866
ccgtgccgtctaatc

SEQ ID NO: 62189 - DNA, 15 bp, Artificial Sequence
  dgRNA
  Pramel4
accgtccttatcttc

SEQ ID NO: 62190 - DNA, 15 bp, Artificial Sequence
  dgRNA
  Trim24
gtttcatcagcaagt

SEQ ID NO: 62191 - DNA, 15 bp, Artificial Sequence
  dgRNA
  Trim24
tgagcggtgtgttct

SEQ ID NO: 62192 - DNA, 15 bp, Artificial Sequence
  dgRNA
  Trim24
atgagcggtgtgttc

SEQ ID NO: 62193 - DNA, 15 bp, Artificial Sequence
  dgRNA
  Trim24
tcatagagtcatgag

SEQ ID NO: 62194 - DNA, 15 bp, Artificial Sequence
  dgRNA
  Crlf3
gcgggcgcagcaaag

SEQ ID NO: 62195 - DNA, 15 bp, Artificial Sequence
  dgRNA
  Crlf3
gcgcagcaaagaggc

SEQ ID NO: 62196 - DNA, 15 bp, Artificial Sequence
  dgRNA
  Crlf3
cagcaaagaggccgg

SEQ ID NO: 62197 - DNA, 15 bp, Artificial Sequence
  dgRNA
  Crlf3
agcagacggcgcagc

SEQ ID NO: 62198 - DNA, 15 bp, Artificial Sequence
  dgRNA
  Fbxo16
ccggatgccagcgac

SEQ ID NO: 62199 - DNA, 15 bp, Artificial Sequence
  dgRNA
  Fbxo16
tttatagatggcgat

SEQ ID NO: 62200 - DNA, 15 bp, Artificial Sequence
  dgRNA
  Fbxo16
tggcgattggcctgc

SEQ ID NO: 62201 - DNA, 15 bp, Artificial Sequence
  dgRNA
  Fbxo16
ggcagtcgggtgagt

SEQ ID NO: 62202 - DNA, 15 bp, Artificial Sequence
  dgRNA
  Pcdh20
tccacattgacaagg

SEQ ID NO: 62203 - DNA, 15 bp, Artificial Sequence
  dgRNA
  Pcdh20
tttcgctattggtga

SEQ ID NO: 62204 - DNA, 15 bp, Artificial Sequence
  dgRNA
  Pcdh20
tttaattttcgctat

SEQ ID NO: 62205 - DNA, 15 bp, Artificial Sequence
  dgRNA
  Pcdh20
ctatgaaatcggtgg

SEQ ID NO: 62206 - DNA, 15 bp, Artificial Sequence
  dgRNA
  Chrng
gcattgtacatatcc

SEQ ID NO: 62207 - DNA, 15 bp, Artificial Sequence
  dgRNA
  Chrng
cattgtacatatcct

SEQ ID NO: 62208 - DNA, 15 bp, Artificial Sequence
  dgRNA
  Chrng
ccaggggacgaaaga

SEQ ID NO: 62209 - DNA, 15 bp, Artificial Sequence
  dgRNA
  Chrng
gggctcagattacat

SEQ ID NO: 62210 - DNA, 15 bp, Artificial Sequence
  dgRNA
  Tcf12
ggatccggaggcgag

SEQ ID NO: 62211 - DNA, 15 bp, Artificial Sequence
  dgRNA
  Tcf12
gaggcgagcggagct

SEQ ID NO: 62212 - DNA, 15 bp, Artificial Sequence
  dgRNA
  Tcf12
cggagctcggtgctg

SEQ ID NO: 62213 - DNA, 15 bp, Artificial Sequence
  dgRNA
  Tcf12
agctccgctcgcctc

SEQ ID NO: 62214 - DNA, 15 bp, Artificial Sequence
  dgRNA
  Cbfa2t3
cggagcgagcgcgat

SEQ ID NO: 62215 - DNA, 15 bp, Artificial Sequence
  dgRNA
  Cbfa2t3
gagcgcgatgggcgt

SEQ ID NO: 62216 - DNA, 15 bp, Artificial Sequence
  dgRNA
  Cbfa2t3
agcgcgatgggcgtc

SEQ ID NO: 62217 - DNA, 15 bp, Artificial Sequence
  dgRNA
  Cbfa2t3
cgatgggcgtcgggc

SEQ ID NO: 62218 - DNA, 15 bp, Artificial Sequence
  dgRNA
  Fkbp10
cccgggtctcagtcc

SEQ ID NO: 62219 - DNA, 15 bp, Artificial Sequence
  dgRNA
  Fkbp10
ggtctcagtcccgga

SEQ ID NO: 62220 - DNA, 15 bp, Artificial Sequence
  dgRNA
  Fkbp10
tcccggatggagttt

SEQ ID NO: 62221 - DNA, 15 bp, Artificial Sequence
  dgRNA
  Fkbp10
cccggatggagtttt

SEQ ID NO: 62222 - DNA, 15 bp, Artificial Sequence
  dgRNA
  Mageb18
attggcaatgtgtct

SEQ ID NO: 62223 - DNA, 15 bp, Artificial Sequence
  dgRNA
  Mageb18
ggcaatgtgtctagg

SEQ ID NO: 62224 - DNA, 15 bp, Artificial Sequence
  dgRNA
  Mageb18
gatgccaactgatta

SEQ ID NO: 62225 - DNA, 15 bp, Artificial Sequence
  dgRNA
  Mageb18
ttattgtctaggcac

SEQ ID NO: 62226 - DNA, 15 bp, Artificial Sequence
  dgRNA
  Sephs2
cctgatctgcgttcc

SEQ ID NO: 62227 - DNA, 15 bp, Artificial Sequence
  dgRNA
  Sephs2
atctgcgttccaggc

SEQ ID NO: 62228 - DNA, 15 bp, Artificial Sequence
  dgRNA
  Sephs2
tccaggccggttaca

SEQ ID NO: 62229 - DNA, 15 bp, Artificial Sequence
  dgRNA
  Sephs2
ccaggccggttacaa

SEQ ID NO: 62230 - DNA, 15 bp, Artificial Sequence
  dgRNA
  Dhrs7c
cctggcatcgactcc

SEQ ID NO: 62231 - DNA, 15 bp, Artificial Sequence
  dgRNA
  Dhrs7c
actcccggcccaagc

SEQ ID NO: 62232 - DNA, 15 bp, Artificial Sequence
  dgRNA
  Dhrs7c
cggcccaagccggag

SEQ ID NO: 62233 - DNA, 15 bp, Artificial Sequence
  dgRNA
  Dhrs7c
gagctttaaaagtcc

SEQ ID NO: 62234 - DNA, 15 bp, Artificial Sequence
  dgRNA
  Wfdc6a
gtgccacccggattc

SEQ ID NO: 62235 - DNA, 15 bp, Artificial Sequence
  dgRNA
  Wfdc6a
acccggattctggac

SEQ ID NO: 62236 - DNA, 15 bp, Artificial Sequence
  dgRNA
  Wfdc6a
cccggattctggact

SEQ ID NO: 62237 - DNA, 15 bp, Artificial Sequence
  dgRNA
  Wfdc6a
aggagcacacgtcca

SEQ ID NO: 62238 - DNA, 15 bp, Artificial Sequence
  dgRNA
  Zfp655
gtggacttccgtcgc

SEQ ID NO: 62239 - DNA, 15 bp, Artificial Sequence
  dgRNA
  Taz
caagtcgtaggctgg

SEQ ID NO: 62240 - DNA, 15 bp, Artificial Sequence
  dgRNA
  Chd1
cactaaaagtgggcg

SEQ ID NO: 62241 - DNA, 15 bp, Artificial Sequence
  dgRNA
  Chd1
ttgcatgcggaagtc

SEQ ID NO: 62242 - DNA, 15 bp, Artificial Sequence
  dgRNA
  Chd1
agtaagcgagaccgg

SEQ ID NO: 62243 - DNA, 15 bp, Artificial Sequence
  dgRNA
  Chd1
atgagtaagcgagac

SEQ ID NO: 62244 - DNA, 15 bp, Artificial Sequence
  dgRNA
  Orc1
tcgtaccggaagctg

SEQ ID NO: 62245 - DNA, 15 bp, Artificial Sequence
  dgRNA
  Orc1
caccccgcaccagag

SEQ ID NO: 62246 - DNA, 15 bp, Artificial Sequence
  dgRNA
  Orc1
accccgcaccagaga

SEQ ID NO: 62247 - DNA, 15 bp, Artificial Sequence
  dgRNA
  Orc1
agggcccaagcaaat

SEQ ID NO: 62248 - DNA, 15 bp, Artificial Sequence
  dgRNA
  Esm1
gggcttttcaattcc

SEQ ID NO: 62249 - DNA, 15 bp, Artificial Sequence
  dgRNA
  Esm1
agccccctactgcac

SEQ ID NO: 62250 - DNA, 15 bp, Artificial Sequence
  dgRNA
  Esm1
aagggggaataacga

SEQ ID NO: 62251 - DNA, 15 bp, Artificial Sequence
  dgRNA
  Esm1
cgtctcaaagactca

SEQ ID NO: 62252 - DNA, 15 bp, Artificial Sequence
  dgRNA
  Med18
cacaccggtgccaga

SEQ ID NO: 62253 - DNA, 15 bp, Artificial Sequence
  dgRNA
  Med18
accggtgccagaagg

SEQ ID NO: 62254 - DNA, 15 bp, Artificial Sequence
  dgRNA
  Med18
ccggtgccagaaggc

SEQ ID NO: 62255 - DNA, 15 bp, Artificial Sequence
  dgRNA
  Med18
cgttccttgccctct

SEQ ID NO: 62256 - DNA, 15 bp, Artificial Sequence
  dgRNA
  Peli3
aggaggctccggtct

SEQ ID NO: 62257 - DNA, 15 bp, Artificial Sequence
  dgRNA
  Peli3
ggaggctccggtctc

SEQ ID NO: 62258 - DNA, 15 bp, Artificial Sequence
  dgRNA
  Peli3
gaggctccggtctcg

SEQ ID NO: 62259 - DNA, 15 bp, Artificial Sequence
  dgRNA
  Peli3
gaggtgtccggagcc

SEQ ID NO: 62260 - DNA, 15 bp, Artificial Sequence
  dgRNA
  Olfr223
tatatgaaaccagct

SEQ ID NO: 62261 - DNA, 15 bp, Artificial Sequence
  dgRNA
  Olfr223
aaaccagctaggttc

SEQ ID NO: 62262 - DNA, 15 bp, Artificial Sequence
  dgRNA
  Olfr223
aaccagctaggttct

SEQ ID NO: 62263 - DNA, 15 bp, Artificial Sequence
  dgRNA
  Olfr223
tattcaaagcacccg

SEQ ID NO: 62264 - DNA, 15 bp, Artificial Sequence
  dgRNA
  Bcat2
acattcacgagccca

SEQ ID NO: 62265 - DNA, 15 bp, Artificial Sequence
  dgRNA
  Bcat2
aagtaaatgcctagc

SEQ ID NO: 62266 - DNA, 15 bp, Artificial Sequence
  dgRNA
  Bcat2
agtaaatgcctagct

SEQ ID NO: 62267 - DNA, 15 bp, Artificial Sequence
  dgRNA
  Bcat2
cttaagctcagcgtt

SEQ ID NO: 62268 - DNA, 15 bp, Artificial Sequence
  dgRNA
  Parpbp
acagggaagcgcccc

SEQ ID NO: 62269 - DNA, 15 bp, Artificial Sequence
  dgRNA
  Parpbp
cagggaagcgcccct

SEQ ID NO: 62270 - DNA, 15 bp, Artificial Sequence
  dgRNA
  Parpbp
caagctggcgatccc

SEQ ID NO: 62271 - DNA, 15 bp, Artificial Sequence
  dgRNA
  Parpbp
atacgcacctaaagc

SEQ ID NO: 62272 - DNA, 15 bp, Artificial Sequence
  dgRNA
  1700039E15Rik
tcatcactggacgca

SEQ ID NO: 62273 - DNA, 15 bp, Artificial Sequence
  dgRNA
  1700039E15Rik
tggacgcatggcgtc

SEQ ID NO: 62274 - DNA, 15 bp, Artificial Sequence
  dgRNA
  1700039E15Rik
cgcatggcgtcaggc

SEQ ID NO: 62275 - DNA, 15 bp, Artificial Sequence
  dgRNA
  1700039E15Rik
atggcgtcaggctgg

SEQ ID NO: 62276 - DNA, 15 bp, Artificial Sequence
  dgRNA
  Alkbh5
gcgagcacactccgg

SEQ ID NO: 62277 - DNA, 15 bp, Artificial Sequence
  dgRNA
  Alkbh5
cgagcacactccggc

SEQ ID NO: 62278 - DNA, 15 bp, Artificial Sequence
  dgRNA
  Alkbh5
gcacactccggcggg

SEQ ID NO: 62279 - DNA, 15 bp, Artificial Sequence
  dgRNA
  Alkbh5
gcgggtggagtccct

SEQ ID NO: 62280 - DNA, 15 bp, Artificial Sequence
  dgRNA
  Zbtb21
cacatgcgtaccctg

SEQ ID NO: 62281 - DNA, 15 bp, Artificial Sequence
  dgRNA
  Zbtb21
acatgcgtaccctgg

SEQ ID NO: 62282 - DNA, 15 bp, Artificial Sequence
  dgRNA
  Zbtb21
gtgcccgcgcctcac

SEQ ID NO: 62283 - DNA, 15 bp, Artificial Sequence
  dgRNA
  Zbtb21
cgcgcctcaccggag

SEQ ID NO: 62284 - DNA, 15 bp, Artificial Sequence
  dgRNA
  Rtp3
gggatgagcggcctc

SEQ ID NO: 62285 - DNA, 15 bp, Artificial Sequence
  dgRNA
  Rtp3
ctcaatacactagtg

SEQ ID NO: 62286 - DNA, 15 bp, Artificial Sequence
  dgRNA
  Pex26
ccagtgcgttctctc

SEQ ID NO: 62287 - DNA, 15 bp, Artificial Sequence
  dgRNA
  Pex26
gcgcgtgcgtcgtag

SEQ ID NO: 62288 - DNA, 15 bp, Artificial Sequence
  dgRNA
  Pex26
tcgccagctttgggg

SEQ ID NO: 62289 - DNA, 15 bp, Artificial Sequence
  dgRNA
  Pex26
gggtcgccagctttg

SEQ ID NO: 62290 - DNA, 15 bp, Artificial Sequence
  dgRNA
  Senp6
catgggggccttccg

SEQ ID NO: 62291 - DNA, 15 bp, Artificial Sequence
  dgRNA
  Senp6
ggggccttccgagga

SEQ ID NO: 62292 - DNA, 15 bp, Artificial Sequence
  dgRNA
  Senp6
gggccttccgaggaa

SEQ ID NO: 62293 - DNA, 15 bp, Artificial Sequence
  dgRNA
  Senp6
ggccttccgaggaag

SEQ ID NO: 62294 - DNA, 15 bp, Artificial Sequence
  dgRNA
  Olfr901
ttatatagggtttac

SEQ ID NO: 62295 - DNA, 15 bp, Artificial Sequence
  dgRNA
  Olfr901
tatatagggtttact

SEQ ID NO: 62296 - DNA, 15 bp, Artificial Sequence
  dgRNA
  Bbc3
cgcccctctggctgc

SEQ ID NO: 62297 - DNA, 15 bp, Artificial Sequence
  dgRNA
  Bbc3
aaaccccccgcgccg

SEQ ID NO: 62298 - DNA, 15 bp, Artificial Sequence
  dgRNA
  Bbc3
cccccgcgccgaggt

SEQ ID NO: 62299 - DNA, 15 bp, Artificial Sequence
  dgRNA
  Bbc3
ccccgcgccgaggta

SEQ ID NO: 62300 - DNA, 15 bp, Artificial Sequence
  dgRNA
  Gckr
agagtatacgcaaag

SEQ ID NO: 62301 - DNA, 15 bp, Artificial Sequence
  dgRNA
  Gckr
ggaagccccggcgac

SEQ ID NO: 62302 - DNA, 15 bp, Artificial Sequence
  dgRNA
  Gckr
ccccggcgacaggaa

SEQ ID NO: 62303 - DNA, 15 bp, Artificial Sequence
  dgRNA
  Gckr
cccggcgacaggaac

SEQ ID NO: 62304 - DNA, 15 bp, Artificial Sequence
  dgRNA
  Cfap52
cccaacatttgcaag

SEQ ID NO: 62305 - DNA, 15 bp, Artificial Sequence
  dgRNA
  Cfap52
caacatttgcaagag

SEQ ID NO: 62306 - DNA, 15 bp, Artificial Sequence
  dgRNA
  Cfap52
tcctctcccgtgtac

SEQ ID NO: 62307 - DNA, 15 bp, Artificial Sequence
  dgRNA
  Cfap52
gacgctaagtgcaca

SEQ ID NO: 62308 - DNA, 15 bp, Artificial Sequence
  dgRNA
  Abra
aaacagaacaccgtc

SEQ ID NO: 62309 - DNA, 15 bp, Artificial Sequence
  dgRNA
  Abra
aacagaacaccgtca

SEQ ID NO: 62310 - DNA, 15 bp, Artificial Sequence
  dgRNA
  Abra
catggcaccacatct

SEQ ID NO: 62311 - DNA, 15 bp, Artificial Sequence
  dgRNA
  Abra
agtttccaccgtcac

SEQ ID NO: 62312 - DNA, 15 bp, Artificial Sequence
  dgRNA
  Pcdhb6
gaatagcacacacgg

SEQ ID NO: 62313 - DNA, 15 bp, Artificial Sequence
  dgRNA
  Pcdhb6
ccaagacgccattcc

SEQ ID NO: 62314 - DNA, 15 bp, Artificial Sequence
  dgRNA
  Pcdhb6
caagacgccattcct

SEQ ID NO: 62315 - DNA, 15 bp, Artificial Sequence
  dgRNA
  Pcdhb6
aatgcttccccgaaa

SEQ ID NO: 62316 - DNA, 15 bp, Artificial Sequence
  dgRNA
  Dpt
cgtgaagtgattctc

SEQ ID NO: 62317 - DNA, 15 bp, Artificial Sequence
  dgRNA
  Dpt
agctggacgcaagca

SEQ ID NO: 62318 - DNA, 15 bp, Artificial Sequence
  dgRNA
  Dpt
gccagtttctcagcg

SEQ ID NO: 62319 - DNA, 15 bp, Artificial Sequence
  dgRNA
  Dpt
acggagagggaccag

SEQ ID NO: 62320 - DNA, 15 bp, Artificial Sequence
  dgRNA
  Wdr48
gaggtagaccagtac

SEQ ID NO: 62321 - DNA, 15 bp, Artificial Sequence
  dgRNA
  Wdr48
cgggcccccaagccc

SEQ ID NO: 62322 - DNA, 15 bp, Artificial Sequence
  dgRNA
  Wdr48
ccctcgcaaccagcc

SEQ ID NO: 62323 - DNA, 15 bp, Artificial Sequence
  dgRNA
  Wdr48
acccaaccacagagt

SEQ ID NO: 62324 - DNA, 15 bp, Artificial Sequence
  dgRNA
  Hmgb3
cacagcaggcgaccg

SEQ ID NO: 62325 - DNA, 15 bp, Artificial Sequence
  dgRNA
  Hmgb3
acagcaggcgaccgc

SEQ ID NO: 62326 - DNA, 15 bp, Artificial Sequence
  dgRNA
  Hmgb3
agaggccgcgcccaa

SEQ ID NO: 62327 - DNA, 15 bp, Artificial Sequence
  dgRNA
  Hmgb3
gaggccgcgcccaat

SEQ ID NO: 62328 - DNA, 15 bp, Artificial Sequence
  dgRNA
  Ripk1
cggggtacttggccg

SEQ ID NO: 62329 - DNA, 15 bp, Artificial Sequence
  dgRNA
  Ripk1
ggggtacttggccgc

SEQ ID NO: 62330 - DNA, 15 bp, Artificial Sequence
  dgRNA
  Ripk1
tacttggccgcggga

SEQ ID NO: 62331 - DNA, 15 bp, Artificial Sequence
  dgRNA
  Ripk1
gcgggaaggcctctg

SEQ ID NO: 62332 - DNA, 15 bp, Artificial Sequence
  dgRNA
  Zfp94
agtatatagcctctc

SEQ ID NO: 62333 - DNA, 15 bp, Artificial Sequence
  dgRNA
  Otop1
cgaggcgcagcggca

SEQ ID NO: 62334 - DNA, 15 bp, Artificial Sequence
  dgRNA
  Otop1
agcggcaggggcaac

SEQ ID NO: 62335 - DNA, 15 bp, Artificial Sequence
  dgRNA
  Otop1
ggggcaacgggttgc

SEQ ID NO: 62336 - DNA, 15 bp, Artificial Sequence
  dgRNA
  Otop1
gggcaacgggttgca

SEQ ID NO: 62337 - DNA, 15 bp, Artificial Sequence
  dgRNA
  Sema3e
gtgaacaaattaatt

SEQ ID NO: 62338 - DNA, 15 bp, Artificial Sequence
  dgRNA
  Sema3e
ttggctcccggatag

SEQ ID NO: 62339 - DNA, 15 bp, Artificial Sequence
  dgRNA
  Sema3e
tggctcccggatagt

SEQ ID NO: 62340 - DNA, 15 bp, Artificial Sequence
  dgRNA
  Sema3e
tcaaagtccttcccg

SEQ ID NO: 62341 - DNA, 15 bp, Artificial Sequence
  dgRNA
  Lrrtm3
gttccccaccactgg

SEQ ID NO: 62342 - DNA, 15 bp, Artificial Sequence
  dgRNA
  Lrrtm3
atcttgcaaatgagc

SEQ ID NO: 62343 - DNA, 15 bp, Artificial Sequence
  dgRNA
  Lrrtm3
ggtggggaacactat

SEQ ID NO: 62344 - DNA, 15 bp, Artificial Sequence
  dgRNA
  Lrrtm3
tggtggggaacacta

SEQ ID NO: 62345 - DNA, 15 bp, Artificial Sequence
  dgRNA
  Ace
cttgcccagggcggg

SEQ ID NO: 62346 - DNA, 15 bp, Artificial Sequence
  dgRNA
  Ace
ttgcccagggcgggc

SEQ ID NO: 62347 - DNA, 15 bp, Artificial Sequence
  dgRNA
  Ace
gggcggggaatcagc

SEQ ID NO: 62348 - DNA, 15 bp, Artificial Sequence
  dgRNA
  Ace
ggcggggaatcagcc

SEQ ID NO: 62349 - DNA, 15 bp, Artificial Sequence
  dgRNA
  Dnajb4
tgcggcattctgtgc

SEQ ID NO: 62350 - DNA, 15 bp, Artificial Sequence
  dgRNA
  Dnajb4
gtttgctaaatccac

SEQ ID NO: 62351 - DNA, 15 bp, Artificial Sequence
  dgRNA
  Dnajb4
taaaagggtacagct

SEQ ID NO: 62352 - DNA, 15 bp, Artificial Sequence
  dgRNA
  Dnajb4
gtacagctaggacga

SEQ ID NO: 62353 - DNA, 15 bp, Artificial Sequence
  dgRNA
  Rxra
gccgggctgcgagcg

SEQ ID NO: 62354 - DNA, 15 bp, Artificial Sequence
  dgRNA
  Rxra
ccgggctgcgagcgc

SEQ ID NO: 62355 - DNA, 15 bp, Artificial Sequence
  dgRNA
  Rxra
cgggctgcgagcgcg

SEQ ID NO: 62356 - DNA, 15 bp, Artificial Sequence
  dgRNA
  Rxra
agcgcggggtggccg

SEQ ID NO: 62357 - DNA, 15 bp, Artificial Sequence
  dgRNA
  Atp2c1
aggaccacgtccatt

SEQ ID NO: 62358 - DNA, 15 bp, Artificial Sequence
  dgRNA
  Atp2c1
ggaccacgtccatta

SEQ ID NO: 62359 - DNA, 15 bp, Artificial Sequence
  dgRNA
  Atp2c1
tccattagggctcgc

SEQ ID NO: 62360 - DNA, 15 bp, Artificial Sequence
  dgRNA
  Atp2c1
tagggctcgcaggct

SEQ ID NO: 62361 - DNA, 15 bp, Artificial Sequence
  dgRNA
  Acot2
aacagtgctaggttc

SEQ ID NO: 62362 - DNA, 15 bp, Artificial Sequence
  dgRNA
  Acot2
aggttccggatataa

SEQ ID NO: 62363 - DNA, 15 bp, Artificial Sequence
  dgRNA
  Acot2
taccccatgaaaagt

SEQ ID NO: 62364 - DNA, 15 bp, Artificial Sequence
  dgRNA
  Acot2
ttaccccatgaaaag

SEQ ID NO: 62365 - DNA, 15 bp, Artificial Sequence
  dgRNA
  Arr3
agaatcccctagctc

SEQ ID NO: 62366 - DNA, 15 bp, Artificial Sequence
  dgRNA
  Arr3
caatcagctgatccc

SEQ ID NO: 62367 - DNA, 15 bp, Artificial Sequence
  dgRNA
  Arr3
gtaggccagagctag

SEQ ID NO: 62368 - DNA, 15 bp, Artificial Sequence
  dgRNA
  Arr3
ggtaggccagagcta

SEQ ID NO: 62369 - DNA, 15 bp, Artificial Sequence
  dgRNA
  Naa11
ccttttaaaccgaga

SEQ ID NO: 62370 - DNA, 15 bp, Artificial Sequence
  dgRNA
  Naa11
ttatcttccaacgtg

SEQ ID NO: 62371 - DNA, 15 bp, Artificial Sequence
  dgRNA
  Naa11
cagtggtacatgtgc

SEQ ID NO: 62372 - DNA, 15 bp, Artificial Sequence
  dgRNA
  Naa11
cggtttaaaaggtat

SEQ ID NO: 62373 - DNA, 15 bp, Artificial Sequence
  dgRNA
  Arl15
agagtcggcctcccg

SEQ ID NO: 62374 - DNA, 15 bp, Artificial Sequence
  dgRNA
  Arl15
gaaccagcaccgtcc

SEQ ID NO: 62375 - DNA, 15 bp, Artificial Sequence
  dgRNA
  Arl15
aaccagcaccgtccc

SEQ ID NO: 62376 - DNA, 15 bp, Artificial Sequence
  dgRNA
  Arl15
tgctgccctccaccg

SEQ ID NO: 62377 - DNA, 15 bp, Artificial Sequence
  dgRNA
  Pdk3
tctcaagacttgatc

SEQ ID NO: 62378 - DNA, 15 bp, Artificial Sequence
  dgRNA
  Pdk3
tcaagacttgatccg

SEQ ID NO: 62379 - DNA, 15 bp, Artificial Sequence
  dgRNA
  Pdk3
agacttgatccgggg

SEQ ID NO: 62380 - DNA, 15 bp, Artificial Sequence
  dgRNA
  Pdk3
gacttgatccggggc

SEQ ID NO: 62381 - DNA, 15 bp, Artificial Sequence
  dgRNA
  Eps8
gctacacctccccct

SEQ ID NO: 62382 - DNA, 15 bp, Artificial Sequence
  dgRNA
  Eps8
aggttagatgagcta

SEQ ID NO: 62383 - DNA, 15 bp, Artificial Sequence
  dgRNA
  Eps8
ggtgtagcaatatgg

SEQ ID NO: 62384 - DNA, 15 bp, Artificial Sequence
  dgRNA
  Eps8
ggaggtgtagcaata

SEQ ID NO: 62385 - DNA, 15 bp, Artificial Sequence
  dgRNA
  Pkig
taggcaacggctcgg

SEQ ID NO: 62386 - DNA, 15 bp, Artificial Sequence
  dgRNA
  Pkig
gcaacggctcggcgg

SEQ ID NO: 62387 - DNA, 15 bp, Artificial Sequence
  dgRNA
  Pkig
caacggctcggcggc

SEQ ID NO: 62388 - DNA, 15 bp, Artificial Sequence
  dgRNA
  Pkig
gctgcgggcgccagg

SEQ ID NO: 62389 - DNA, 15 bp, Artificial Sequence
  dgRNA
  Wdr60
tcgttgtcaactgtg

SEQ ID NO: 62390 - DNA, 15 bp, Artificial Sequence
  dgRNA
  Wdr60
aaaacacgggcgcgc

SEQ ID NO: 62391 - DNA, 15 bp, Artificial Sequence
  dgRNA
  Wdr60
cgcaggcgcgcgtgc

SEQ ID NO: 62392 - DNA, 15 bp, Artificial Sequence
  dgRNA
  Wdr60
gcaggcgcgcgtgct

SEQ ID NO: 62393 - DNA, 15 bp, Artificial Sequence
  dgRNA
  Nkg7
actacctagaacacg

SEQ ID NO: 62394 - DNA, 15 bp, Artificial Sequence
  dgRNA
  Nkg7
ctacctagaacacga

SEQ ID NO: 62395 - DNA, 15 bp, Artificial Sequence
  dgRNA
  Nkg7
gctgcaagcaagtaa

SEQ ID NO: 62396 - DNA, 15 bp, Artificial Sequence
  dgRNA
  Nkg7
cccctaccacatagg

SEQ ID NO: 62397 - DNA, 15 bp, Artificial Sequence
  dgRNA
  Pax7
acttcttttcgttat

SEQ ID NO: 62398 - DNA, 15 bp, Artificial Sequence
  dgRNA
  Pax7
ctctccctcccgaac

SEQ ID NO: 62399 - DNA, 15 bp, Artificial Sequence
  dgRNA
  Pax7
ggggccagttcggga

SEQ ID NO: 62400 - DNA, 15 bp, Artificial Sequence
  dgRNA
  Pax7
gggggccagttcggg

SEQ ID NO: 62401 - DNA, 15 bp, Artificial Sequence
  dgRNA
  Rad54l
tcgattgacactgcc

SEQ ID NO: 62402 - DNA, 15 bp, Artificial Sequence
  dgRNA
  Rad54l
tcttaacgcgcgctt

SEQ ID NO: 62403 - DNA, 15 bp, Artificial Sequence
  dgRNA
  Rad54l
cttaacgcgcgcttt

SEQ ID NO: 62404 - DNA, 15 bp, Artificial Sequence
  dgRNA
  Rad54l
gcgttaagagcctcc

SEQ ID NO: 62405 - DNA, 15 bp, Artificial Sequence
  dgRNA
  Agbl3
ccccgctcgccgctt

SEQ ID NO: 62406 - DNA, 15 bp, Artificial Sequence
  dgRNA
  Agbl3
cccgctcgccgcttc

SEQ ID NO: 62407 - DNA, 15 bp, Artificial Sequence
  dgRNA
  Agbl3
tcgccgcttcgggcg

SEQ ID NO: 62408 - DNA, 15 bp, Artificial Sequence
  dgRNA
  Agbl3
gcttcgggcgcggac

SEQ ID NO: 62409 - DNA, 15 bp, Artificial Sequence
  dgRNA
  Myo9b
gggctaaaatactgc

SEQ ID NO: 62410 - DNA, 15 bp, Artificial Sequence
  dgRNA
  Myo9b
cgcccctctcagctg

SEQ ID NO: 62411 - DNA, 15 bp, Artificial Sequence
  dgRNA
  Myo9b
ggaacacttagcatc

SEQ ID NO: 62412 - DNA, 15 bp, Artificial Sequence
  dgRNA
  Myo9b
atgcaccaaccgcag

SEQ ID NO: 62413 - DNA, 15 bp, Artificial Sequence
  dgRNA
  Dnaaf2
tcccaggcgttacta

SEQ ID NO: 62414 - DNA, 15 bp, Artificial Sequence
  dgRNA
  Dnaaf2
gacactacctgctac

SEQ ID NO: 62415 - DNA, 15 bp, Artificial Sequence
  dgRNA
  Dnaaf2
taacgcctgggagga

SEQ ID NO: 62416 - DNA, 15 bp, Artificial Sequence
  dgRNA
  Dnaaf2
gtaacgcctgggagg

SEQ ID NO: 62417 - DNA, 15 bp, Artificial Sequence
  dgRNA
  15-Sep
ttgacgcacgctgcc

SEQ ID NO: 62418 - DNA, 15 bp, Artificial Sequence
  dgRNA
  15-Sep
catcctccggtacag

SEQ ID NO: 62419 - DNA, 15 bp, Artificial Sequence
  dgRNA
  15-Sep
cattggtccgaagag

SEQ ID NO: 62420 - DNA, 15 bp, Artificial Sequence
  dgRNA
  15-Sep
tttcggttcgattta

SEQ ID NO: 62421 - DNA, 15 bp, Artificial Sequence
  dgRNA
  Rpl17
tctcgttccttgggc

SEQ ID NO: 62422 - DNA, 15 bp, Artificial Sequence
  dgRNA
  Rpl17
acagtcatgaagcgt

SEQ ID NO: 62423 - DNA, 15 bp, Artificial Sequence
  dgRNA
  Rpl17
cgaaattaaaatgta

SEQ ID NO: 62424 - DNA, 15 bp, Artificial Sequence
  dgRNA
  Rpl17
agtgcgtgcgtcttt

SEQ ID NO: 62425 - DNA, 15 bp, Artificial Sequence
  dgRNA
  Ipcef1
gcaagagctgcttgt

SEQ ID NO: 62426 - DNA, 15 bp, Artificial Sequence
  dgRNA
  Ipcef1
attttgtgcctcagc

SEQ ID NO: 62427 - DNA, 15 bp, Artificial Sequence
  dgRNA
  Ipcef1
ctgcttaggttagca

SEQ ID NO: 62428 - DNA, 15 bp, Artificial Sequence
  dgRNA
  Ipcef1
cattgagccgaacct

SEQ ID NO: 62429 - DNA, 15 bp, Artificial Sequence
  dgRNA
  Fbxw2
attgtgcaaatctag

SEQ ID NO: 62430 - DNA, 15 bp, Artificial Sequence
  dgRNA
  Fbxw2
ttgctcaggatcata

SEQ ID NO: 62431 - DNA, 15 bp, Artificial Sequence
  dgRNA
  Fbxw2
tgtaagcgcagacgg

SEQ ID NO: 62432 - DNA, 15 bp, Artificial Sequence
  dgRNA
  Fbxw2
ccttttccacagtcg

SEQ ID NO: 62433 - DNA, 15 bp, Artificial Sequence
  dgRNA
  Slc6a7
cgtaactgcgaccga

SEQ ID NO: 62434 - DNA, 15 bp, Artificial Sequence
  dgRNA
  Slc6a7
ccgcagctctgcgtg

SEQ ID NO: 62435 - DNA, 15 bp, Artificial Sequence
  dgRNA
  Slc6a7
cgcagctctgcgtgc

SEQ ID NO: 62436 - DNA, 15 bp, Artificial Sequence
  dgRNA
  Slc6a7
gcagctctgcgtgcg

SEQ ID NO: 62437 - DNA, 15 bp, Artificial Sequence
  dgRNA
  Mtfp1
attccattctccgat

SEQ ID NO: 62438 - DNA, 15 bp, Artificial Sequence
  dgRNA
  Mtfp1
aaaactagtcatgtc

SEQ ID NO: 62439 - DNA, 15 bp, Artificial Sequence
  dgRNA
  Mtfp1
tcgtgtgtaaatggg

SEQ ID NO: 62440 - DNA, 15 bp, Artificial Sequence
  dgRNA
  Mtfp1
ggttcgtgtgtaaat

SEQ ID NO: 62441 - DNA, 15 bp, Artificial Sequence
  dgRNA
  Hspb7
ccatgggagagcgag

SEQ ID NO: 62442 - DNA, 15 bp, Artificial Sequence
  dgRNA
  Hspb7
aggaggtggttatat

SEQ ID NO: 62443 - DNA, 15 bp, Artificial Sequence
  dgRNA
  Hspb7
tgtactccaaaatta

SEQ ID NO: 62444 - DNA, 15 bp, Artificial Sequence
  dgRNA
  Hspb7
tccaaaattaaggca

SEQ ID NO: 62445 - DNA, 15 bp, Artificial Sequence
  dgRNA
  Sema4b
ggacttcggcctacg

SEQ ID NO: 62446 - DNA, 15 bp, Artificial Sequence
  dgRNA
  Sema4b
tgtatgtgatacagt

SEQ ID NO: 62447 - DNA, 15 bp, Artificial Sequence
  dgRNA
  Sema4b
ggccctggcccgacg

SEQ ID NO: 62448 - DNA, 15 bp, Artificial Sequence
  dgRNA
  Sema4b
gccctggcccgacgt

SEQ ID NO: 62449 - DNA, 15 bp, Artificial Sequence
  dgRNA
  Skint1
aggtaatcagttcat

SEQ ID NO: 62450 - DNA, 15 bp, Artificial Sequence
  dgRNA
  Skint1
ggtaatgaattctcc

SEQ ID NO: 62451 - DNA, 15 bp, Artificial Sequence
  dgRNA
  Skint1
gtaatgaattctcct

SEQ ID NO: 62452 - DNA, 15 bp, Artificial Sequence
  dgRNA
  Skint1
ggtcctatctgcatc

SEQ ID NO: 62453 - DNA, 15 bp, Artificial Sequence
  dgRNA
  Olfr1160
atattcgtgacaaat

SEQ ID NO: 62454 - DNA, 15 bp, Artificial Sequence
  dgRNA
  Elfn2
ccataagacccccaa

SEQ ID NO: 62455 - DNA, 15 bp, Artificial Sequence
  dgRNA
  Elfn2
ggaccaccctgcgca

SEQ ID NO: 62456 - DNA, 15 bp, Artificial Sequence
  dgRNA
  Elfn2
ccaccctgcgcaagg

SEQ ID NO: 62457 - DNA, 15 bp, Artificial Sequence
  dgRNA
  Elfn2
ccctgcgcaaggtgg

SEQ ID NO: 62458 - DNA, 15 bp, Artificial Sequence
  dgRNA
  Olfr1101
taagtaattgaatgc

SEQ ID NO: 62459 - DNA, 15 bp, Artificial Sequence
  dgRNA
  Olfr1101
tcagtatttgcacct

SEQ ID NO: 62460 - DNA, 15 bp, Artificial Sequence
  dgRNA
  Olfr1101
gttgataactgaaag

SEQ ID NO: 62461 - DNA, 15 bp, Artificial Sequence
  dgRNA
  Olfr1101
atggtataaatgccc

SEQ ID NO: 62462 - DNA, 15 bp, Artificial Sequence
  dgRNA
  Pcsk4
ttgaacctgctccta

SEQ ID NO: 62463 - DNA, 15 bp, Artificial Sequence
  dgRNA
  Pcsk4
tgaacctgctcctaa

SEQ ID NO: 62464 - DNA, 15 bp, Artificial Sequence
  dgRNA
  Pcsk4
gggttgtccttgtat

SEQ ID NO: 62465 - DNA, 15 bp, Artificial Sequence
  dgRNA
  Pcsk4
aagtgaggttcccga

SEQ ID NO: 62466 - DNA, 15 bp, Artificial Sequence
  dgRNA
  Sestd1
gcacgcgaggtcgcg

SEQ ID NO: 62467 - DNA, 15 bp, Artificial Sequence
  dgRNA
  Sestd1
cgaggtcgcgcggac

SEQ ID NO: 62468 - DNA, 15 bp, Artificial Sequence
  dgRNA
  Sestd1
gaggtcgcgcggaca

SEQ ID NO: 62469 - DNA, 15 bp, Artificial Sequence
  dgRNA
  Sestd1
cgcgcggacagggcc

SEQ ID NO: 62470 - DNA, 15 bp, Artificial Sequence
  dgRNA
  Plcb1
ctttacatactggtt

SEQ ID NO: 62471 - DNA, 15 bp, Artificial Sequence
  dgRNA
  Plcb1
cattgaggcagaacg

SEQ ID NO: 62472 - DNA, 15 bp, Artificial Sequence
  dgRNA
  Abl1
ctttaaaaggtcgtg

SEQ ID NO: 62473 - DNA, 15 bp, Artificial Sequence
  dgRNA
  Abl1
aaggtcgtgcggagc

SEQ ID NO: 62474 - DNA, 15 bp, Artificial Sequence
  dgRNA
  Abl1
aggtcgtgcggagcc

SEQ ID NO: 62475 - DNA, 15 bp, Artificial Sequence
  dgRNA
  Abl1
gagccgggttgtcgc

SEQ ID NO: 62476 - DNA, 15 bp, Artificial Sequence
  dgRNA
  Rps23
cacactccccggtac

SEQ ID NO: 62477 - DNA, 15 bp, Artificial Sequence
  dgRNA
  Rps23
ggtacaggcgccgct

SEQ ID NO: 62478 - DNA, 15 bp, Artificial Sequence
  dgRNA
  Rps23
gcttggacagccgca

SEQ ID NO: 62479 - DNA, 15 bp, Artificial Sequence
  dgRNA
  Rps23
cttggacagccgcac

SEQ ID NO: 62480 - DNA, 15 bp, Artificial Sequence
  dgRNA
  Inhba
gccaataccatgaag

SEQ ID NO: 62481 - DNA, 15 bp, Artificial Sequence
  dgRNA
  Inhba
ggctttgtttaggat

SEQ ID NO: 62482 - DNA, 15 bp, Artificial Sequence
  dgRNA
  Inhba
tcctcttcatggtat

SEQ ID NO: 62483 - DNA, 15 bp, Artificial Sequence
  dgRNA
  Slc7a6
cccagtcacagcccg

SEQ ID NO: 62484 - DNA, 15 bp, Artificial Sequence
  dgRNA
  Slc7a6
ccagtcacagcccgc

SEQ ID NO: 62485 - DNA, 15 bp, Artificial Sequence
  dgRNA
  Slc7a6
cagtcacagcccgcg

SEQ ID NO: 62486 - DNA, 15 bp, Artificial Sequence
  dgRNA
  Slc7a6
cccgcggggagagtc

SEQ ID NO: 62487 - DNA, 15 bp, Artificial Sequence
  dgRNA
  Isl1
gagcgacgtggcctc

SEQ ID NO: 62488 - DNA, 15 bp, Artificial Sequence
  dgRNA
  Isl1
cgacgtggcctcggg

SEQ ID NO: 62489 - DNA, 15 bp, Artificial Sequence
  dgRNA
  Isl1
ttaatcctctcctgc

SEQ ID NO: 62490 - DNA, 15 bp, Artificial Sequence
  dgRNA
  Isl1
tgcgggctcgccgag

SEQ ID NO: 62491 - DNA, 15 bp, Artificial Sequence
  dgRNA
  Rrh
aagatgtgaggcggt

SEQ ID NO: 62492 - DNA, 15 bp, Artificial Sequence
  dgRNA
  Rrh
aagcactttaggtcc

SEQ ID NO: 62493 - DNA, 15 bp, Artificial Sequence
  dgRNA
  Rd3
actttagcacctcta

SEQ ID NO: 62494 - DNA, 15 bp, Artificial Sequence
  dgRNA
  Rd3
tgtacagcagcgacc

SEQ ID NO: 62495 - DNA, 15 bp, Artificial Sequence
  dgRNA
  Rd3
gtccaataagacact

SEQ ID NO: 62496 - DNA, 15 bp, Artificial Sequence
  dgRNA
  Rd3
tccaataagacacta

SEQ ID NO: 62497 - DNA, 15 bp, Artificial Sequence
  dgRNA
  Ppp1r42
ctaactggtcttttt

SEQ ID NO: 62498 - DNA, 15 bp, Artificial Sequence
  dgRNA
  Ppp1r42
gagccagactcaagg

SEQ ID NO: 62499 - DNA, 15 bp, Artificial Sequence
  dgRNA
  Ppp1r42
tcaaggcgggccctg

SEQ ID NO: 62500 - DNA, 15 bp, Artificial Sequence
  dgRNA
  Ppp1r42
caaggcgggccctgc

SEQ ID NO: 62501 - DNA, 15 bp, Artificial Sequence
  dgRNA
  Krtap16-1
gcccaaacaacaatg

SEQ ID NO: 62502 - DNA, 15 bp, Artificial Sequence
  dgRNA
  Krtap16-1
cagcatgcgccagtg

SEQ ID NO: 62503 - DNA, 15 bp, Artificial Sequence
  dgRNA
  Krtap16-1
agcatgcgccagtga

SEQ ID NO: 62504 - DNA, 15 bp, Artificial Sequence
  dgRNA
  Krtap16-1
cttgcatgctaaata

SEQ ID NO: 62505 - DNA, 15 bp, Artificial Sequence
  dgRNA
  Ptch1
tcgcgtcgcccgcag

SEQ ID NO: 62506 - DNA, 15 bp, Artificial Sequence
  dgRNA
  Ptch1
cgcgtcgcccgcagc

SEQ ID NO: 62507 - DNA, 15 bp, Artificial Sequence
  dgRNA
  Ptch1
ccgcagcgggcgccg

SEQ ID NO: 62508 - DNA, 15 bp, Artificial Sequence
  dgRNA
  Ptch1
cgcagcgggcgccga

SEQ ID NO: 62509 - DNA, 15 bp, Artificial Sequence
  dgRNA
  Trim2
gtatcaagggacaat

SEQ ID NO: 62510 - DNA, 15 bp, Artificial Sequence
  dgRNA
  Trim2
gggctgtggtatcaa

SEQ ID NO: 62511 - DNA, 15 bp, Artificial Sequence
  dgRNA
  Olfr1297
cctcatacttccagt

SEQ ID NO: 62512 - DNA, 15 bp, Artificial Sequence
  dgRNA
  Olfr1297
ctattgaaacttgcc

SEQ ID NO: 62513 - DNA, 15 bp, Artificial Sequence
  dgRNA
  Olfr1297
ccaactggaagtatg

SEQ ID NO: 62514 - DNA, 15 bp, Artificial Sequence
  dgRNA
  Sqle
gcgactggcgccgcg

SEQ ID NO: 62515 - DNA, 15 bp, Artificial Sequence
  dgRNA
  Sqle
tgcgccgcccgccat

SEQ ID NO: 62516 - DNA, 15 bp, Artificial Sequence
  dgRNA
  Sqle
tctcagcctaccgcg

SEQ ID NO: 62517 - DNA, 15 bp, Artificial Sequence
  dgRNA
  Sqle
ggtgcgcgctctcat

SEQ ID NO: 62518 - DNA, 15 bp, Artificial Sequence
  dgRNA
  Car12
tttagggttgagtcg

SEQ ID NO: 62519 - DNA, 15 bp, Artificial Sequence
  dgRNA
  Orai3
cacctgtgaatgtcc

SEQ ID NO: 62520 - DNA, 15 bp, Artificial Sequence
  dgRNA
  Orai3
tccaggtacatacac

SEQ ID NO: 62521 - DNA, 15 bp, Artificial Sequence
  dgRNA
  Orai3
ccaggtacatacact

SEQ ID NO: 62522 - DNA, 15 bp, Artificial Sequence
  dgRNA
  Orai3
ggtacatacactggg

SEQ ID NO: 62523 - DNA, 15 bp, Artificial Sequence
  dgRNA
  Gprin2
agcggccggctctgt

SEQ ID NO: 62524 - DNA, 15 bp, Artificial Sequence
  dgRNA
  Gprin2
gcggccggctctgtc

SEQ ID NO: 62525 - DNA, 15 bp, Artificial Sequence
  dgRNA
  Gprin2
ccggctctgtcggga

SEQ ID NO: 62526 - DNA, 15 bp, Artificial Sequence
  dgRNA
  Gprin2
gaaggttgcacaaaa

SEQ ID NO: 62527 - DNA, 15 bp, Artificial Sequence
  dgRNA
  Mapk6
gttcagctgaggccg

SEQ ID NO: 62528 - DNA, 15 bp, Artificial Sequence
  dgRNA
  Mapk6
ggtgtacccgccagc

SEQ ID NO: 62529 - DNA, 15 bp, Artificial Sequence
  dgRNA
  Mapk6
ctccgaccgcccccg

SEQ ID NO: 62530 - DNA, 15 bp, Artificial Sequence
  dgRNA
  Mapk6
cggcgcgcgcagtca

SEQ ID NO: 62531 - DNA, 15 bp, Artificial Sequence
  dgRNA
  Zfp715
gtggcctccaacgtc

SEQ ID NO: 62532 - DNA, 15 bp, Artificial Sequence
  dgRNA
  Zfp715
ggtcaaaagtgttag

SEQ ID NO: 62533 - DNA, 15 bp, Artificial Sequence
  dgRNA
  Zfp715
gtcaaaagtgttagt

SEQ ID NO: 62534 - DNA, 15 bp, Artificial Sequence
  dgRNA
  Zfp715
tgcgcattattctac

SEQ ID NO: 62535 - DNA, 15 bp, Artificial Sequence
  dgRNA
  Kctd12b
gcagaatagagcggg

SEQ ID NO: 62536 - DNA, 15 bp, Artificial Sequence
  dgRNA
  Kctd12b
aatagagcgggaggc

SEQ ID NO: 62537 - DNA, 15 bp, Artificial Sequence
  dgRNA
  Ube2dnl1
gaaaatggccgaagc

SEQ ID NO: 62538 - DNA, 15 bp, Artificial Sequence
  dgRNA
  Ube2dnl1
gcgtgaagtcattgt

SEQ ID NO: 62539 - DNA, 15 bp, Artificial Sequence
  dgRNA
  Ube2dnl1
agcgtgaagtcattg

SEQ ID NO: 62540 - DNA, 15 bp, Artificial Sequence
  dgRNA
  Ube2dnl1
ggtcagcgtcgggta

SEQ ID NO: 62541 - DNA, 15 bp, Artificial Sequence
  dgRNA
  Grip1
tcactcgctggtcgc

SEQ ID NO: 62542 - DNA, 15 bp, Artificial Sequence
  dgRNA
  Hepacam
ccgtcctgaaacaga

SEQ ID NO: 62543 - DNA, 15 bp, Artificial Sequence
  dgRNA
  Hepacam
tggagccttctaaat

SEQ ID NO: 62544 - DNA, 15 bp, Artificial Sequence
  dgRNA
  Hepacam
aaaaggtggccgggt

SEQ ID NO: 62545 - DNA, 15 bp, Artificial Sequence
  dgRNA
  Hepacam
gaaaaggtggccggg

SEQ ID NO: 62546 - DNA, 15 bp, Artificial Sequence
  dgRNA
  Caml
tgtgaggtaacctgg

SEQ ID NO: 62547 - DNA, 15 bp, Artificial Sequence
  dgRNA
  Caml
actgcgagccaactt

SEQ ID NO: 62548 - DNA, 15 bp, Artificial Sequence
  dgRNA
  Caml
agggaacccttgaac

SEQ ID NO: 62549 - DNA, 15 bp, Artificial Sequence
  dgRNA
  Caml
gggaacccttgaact

SEQ ID NO: 62550 - DNA, 15 bp, Artificial Sequence
  dgRNA
  Dhodh
gccataccgcagcac

SEQ ID NO: 62551 - DNA, 15 bp, Artificial Sequence
  dgRNA
  Dhodh
ataaagacaaccgtg

SEQ ID NO: 62552 - DNA, 15 bp, Artificial Sequence
  dgRNA
  Dhodh
accgtgcggaacctt

SEQ ID NO: 62553 - DNA, 15 bp, Artificial Sequence
  dgRNA
  Dhodh
ccgtgcggaaccttc

SEQ ID NO: 62554 - DNA, 15 bp, Artificial Sequence
  dgRNA
  Zcchc24
aggataggaccgaac

SEQ ID NO: 62555 - DNA, 15 bp, Artificial Sequence
  dgRNA
  Zcchc24
taggaccgaactggc

SEQ ID NO: 62556 - DNA, 15 bp, Artificial Sequence
  dgRNA
  Zcchc24
aggaccgaactggcc

SEQ ID NO: 62557 - DNA, 15 bp, Artificial Sequence
  dgRNA
  Zcchc24
ggaccgaactggccg

SEQ ID NO: 62558 - DNA, 15 bp, Artificial Sequence
  dgRNA
  Ap1g1
tcgggtcatccgggg

SEQ ID NO: 62559 - DNA, 15 bp, Artificial Sequence
  dgRNA
  Ap1g1
cgggtcatccggggt

SEQ ID NO: 62560 - DNA, 15 bp, Artificial Sequence
  dgRNA
  Ap1g1
ggcacgggctgcagt

SEQ ID NO: 62561 - DNA, 15 bp, Artificial Sequence
  dgRNA
  Ap1g1
acgggctgcagtcgg

SEQ ID NO: 62562 - DNA, 15 bp, Artificial Sequence
  dgRNA
  Mest
agccctcgagacaga

SEQ ID NO: 62563 - DNA, 15 bp, Artificial Sequence
  dgRNA
  Mest
aagggctcgtgtgca

SEQ ID NO: 62564 - DNA, 15 bp, Artificial Sequence
  dgRNA
  Mest
agggctcgtgtgcat

SEQ ID NO: 62565 - DNA, 15 bp, Artificial Sequence
  dgRNA
  Mest
gggctcgtgtgcatg

SEQ ID NO: 62566 - DNA, 15 bp, Artificial Sequence
  dgRNA
  Gfm2
gacgcgggcgacgaa

SEQ ID NO: 62567 - DNA, 15 bp, Artificial Sequence
  dgRNA
  Gfm2
ggacgcgggcgacga

SEQ ID NO: 62568 - DNA, 15 bp, Artificial Sequence
  dgRNA
  Sema3a
taatagccttcattg

SEQ ID NO: 62569 - DNA, 15 bp, Artificial Sequence
  dgRNA
  Sema3a
tctaagcgctgccac

SEQ ID NO: 62570 - DNA, 15 bp, Artificial Sequence
  dgRNA
  Wfdc9
ccggctcatagaaac

SEQ ID NO: 62571 - DNA, 15 bp, Artificial Sequence
  dgRNA
  Wfdc9
gctcatagaaaccgg

SEQ ID NO: 62572 - DNA, 15 bp, Artificial Sequence
  dgRNA
  Wfdc9
accggaggtagttca

SEQ ID NO: 62573 - DNA, 15 bp, Artificial Sequence
  dgRNA
  Wfdc9
gtgaggctaacaaat

SEQ ID NO: 62574 - DNA, 15 bp, Artificial Sequence
  dgRNA
  Atp5a1
tttcggatagttccc

SEQ ID NO: 62575 - DNA, 15 bp, Artificial Sequence
  dgRNA
  Atp5a1
ggactaaaaccctct

SEQ ID NO: 62576 - DNA, 15 bp, Artificial Sequence
  dgRNA
  Atp5a1
ctaaaaccctctggg

SEQ ID NO: 62577 - DNA, 15 bp, Artificial Sequence
  dgRNA
  Atp5a1
gtgcaagagctaccc

SEQ ID NO: 62578 - DNA, 15 bp, Artificial Sequence
  dgRNA
  Mxd4
ctaaattgttactac

SEQ ID NO: 62579 - DNA, 15 bp, Artificial Sequence
  dgRNA
  Mxd4
tctgcccgaggcgtt

SEQ ID NO: 62580 - DNA, 15 bp, Artificial Sequence
  dgRNA
  Mxd4
tcggccagtccctat

SEQ ID NO: 62581 - DNA, 15 bp, Artificial Sequence
  dgRNA
  Mxd4
cggccagtccctatt

SEQ ID NO: 62582 - DNA, 15 bp, Artificial Sequence
  dgRNA
  4930432K21Rik
ggcggagcatgcgta

SEQ ID NO: 62583 - DNA, 15 bp, Artificial Sequence
  dgRNA
  4930432K21Rik
cgtaaggtgtgtagt

SEQ ID NO: 62584 - DNA, 15 bp, Artificial Sequence
  dgRNA
  4930432K21Rik
gccctactttatgct

SEQ ID NO: 62585 - DNA, 15 bp, Artificial Sequence
  dgRNA
  Aurkaip1
ttcacttgagattag

SEQ ID NO: 62586 - DNA, 15 bp, Artificial Sequence
  dgRNA
  Aurkaip1
cttgagattagcggc

SEQ ID NO: 62587 - DNA, 15 bp, Artificial Sequence
  dgRNA
  Aurkaip1
ttgagattagcggca

SEQ ID NO: 62588 - DNA, 15 bp, Artificial Sequence
  dgRNA
  Aurkaip1
gattagcggcagggt

SEQ ID NO: 62589 - DNA, 15 bp, Artificial Sequence
  dgRNA
  Tti1
atccctcactaacct

SEQ ID NO: 62590 - DNA, 15 bp, Artificial Sequence
  dgRNA
  Tti1
ggatactccaagaat

SEQ ID NO: 62591 - DNA, 15 bp, Artificial Sequence
  dgRNA
  Tti1
tcccctttgcacttg

SEQ ID NO: 62592 - DNA, 15 bp, Artificial Sequence
  dgRNA
  Tti1
gggccccgtgaatgt

SEQ ID NO: 62593 - DNA, 15 bp, Artificial Sequence
  dgRNA
  Tbx5
cagcaggtcctatag

SEQ ID NO: 62594 - DNA, 15 bp, Artificial Sequence
  dgRNA
  Tbx5
gtggttcaagagttt

SEQ ID NO: 62595 - DNA, 15 bp, Artificial Sequence
  dgRNA
  Tbx5
ctcttgaaccactat

SEQ ID NO: 62596 - DNA, 15 bp, Artificial Sequence
  dgRNA
  Trub2
acataaccgagaatt

SEQ ID NO: 62597 - DNA, 15 bp, Artificial Sequence
  dgRNA
  Trub2
cggttgctcgatatc

SEQ ID NO: 62598 - DNA, 15 bp, Artificial Sequence
  dgRNA
  Trub2
ttatttcccccccgg

SEQ ID NO: 62599 - DNA, 15 bp, Artificial Sequence
  dgRNA
  Trub2
tatttcccccccgga

SEQ ID NO: 62600 - DNA, 15 bp, Artificial Sequence
  dgRNA
  Nedd1
gcctaactcagcgcc

SEQ ID NO: 62601 - DNA, 15 bp, Artificial Sequence
  dgRNA
  Nedd1
ctctgcaccgcccca

SEQ ID NO: 62602 - DNA, 15 bp, Artificial Sequence
  dgRNA
  Nedd1
tgcaccgccccaggg

SEQ ID NO: 62603 - DNA, 15 bp, Artificial Sequence
  dgRNA
  Nedd1
gcaccgccccagggt

SEQ ID NO: 62604 - DNA, 15 bp, Artificial Sequence
  dgRNA
  Lrrc23
tttggcctcgtaacc

SEQ ID NO: 62605 - DNA, 15 bp, Artificial Sequence
  dgRNA
  Lrrc23
ctgagctacccgctg

SEQ ID NO: 62606 - DNA, 15 bp, Artificial Sequence
  dgRNA
  Lrrc23
tgagctacccgctga

SEQ ID NO: 62607 - DNA, 15 bp, Artificial Sequence
  dgRNA
  Lrrc23
gctacccgctgaggg

SEQ ID NO: 62608 - DNA, 15 bp, Artificial Sequence
  dgRNA
  Ogdhl
tccagtcactcagac

SEQ ID NO: 62609 - DNA, 15 bp, Artificial Sequence
  dgRNA
  Ogdhl
gcacctcggacagcg

SEQ ID NO: 62610 - DNA, 15 bp, Artificial Sequence
  dgRNA
  Ogdhl
cacctcggacagcga

SEQ ID NO: 62611 - DNA, 15 bp, Artificial Sequence
  dgRNA
  Ogdhl
gcgagggccgcagac

SEQ ID NO: 62612 - DNA, 15 bp, Artificial Sequence
  dgRNA
  Ncald
caaccaatgctctct

SEQ ID NO: 62613 - DNA, 15 bp, Artificial Sequence
  dgRNA
  Ncald
tttgacgtcagccag

SEQ ID NO: 62614 - DNA, 15 bp, Artificial Sequence
  dgRNA
  Ncald
gtagcaaccacagac

SEQ ID NO: 62615 - DNA, 15 bp, Artificial Sequence
  dgRNA
  Lzts3
gagagtgggccactc

SEQ ID NO: 62616 - DNA, 15 bp, Artificial Sequence
  dgRNA
  Lzts3
ggccaggcccccatg

SEQ ID NO: 62617 - DNA, 15 bp, Artificial Sequence
  dgRNA
  Lzts3
ccatgaggccaagtt

SEQ ID NO: 62618 - DNA, 15 bp, Artificial Sequence
  dgRNA
  Lzts3
gttaggaaaacctct

SEQ ID NO: 62619 - DNA, 15 bp, Artificial Sequence
  dgRNA
  Dbnl
ggcttccggcctccg

SEQ ID NO: 62620 - DNA, 15 bp, Artificial Sequence
  dgRNA
  Dbnl
ttccggcctccgggg

SEQ ID NO: 62621 - DNA, 15 bp, Artificial Sequence
  dgRNA
  Dbnl
tccggcctccggggc

SEQ ID NO: 62622 - DNA, 15 bp, Artificial Sequence
  dgRNA
  Dbnl
ccggcctccggggcg

SEQ ID NO: 62623 - DNA, 15 bp, Artificial Sequence
  dgRNA
  Pold3
cagcggtgaaatata

SEQ ID NO: 62624 - DNA, 15 bp, Artificial Sequence
  dgRNA
  Pold3
aatcgcaacgttctc

SEQ ID NO: 62625 - DNA, 15 bp, Artificial Sequence
  dgRNA
  Pold3
gcacaccgacaacca

SEQ ID NO: 62626 - DNA, 15 bp, Artificial Sequence
  dgRNA
  Pold3
cacaccgacaaccac

SEQ ID NO: 62627 - DNA, 15 bp, Artificial Sequence
  dgRNA
  Utp11l
ccagatgccaacgtg

SEQ ID NO: 62628 - DNA, 15 bp, Artificial Sequence
  dgRNA
  Utp11l
tgccaacgtgcggcc

SEQ ID NO: 62629 - DNA, 15 bp, Artificial Sequence
  dgRNA
  Utp11l
cctggagcgaagtct

SEQ ID NO: 62630 - DNA, 15 bp, Artificial Sequence
  dgRNA
  Utp11l
cgaagtctaggtctc

SEQ ID NO: 62631 - DNA, 15 bp, Artificial Sequence
  dgRNA
  9130401M01Rik
gctctagacacaaag

SEQ ID NO: 62632 - DNA, 15 bp, Artificial Sequence
  dgRNA
  9130401M01Rik
gtcaaaacctttgtt

SEQ ID NO: 62633 - DNA, 15 bp, Artificial Sequence
  dgRNA
  9130401M01Rik
cagaatgcaacgctc

SEQ ID NO: 62634 - DNA, 15 bp, Artificial Sequence
  dgRNA
  9130401M01Rik
cccaccgcttccgtg

SEQ ID NO: 62635 - DNA, 15 bp, Artificial Sequence
  dgRNA
  C5ar1
aaaacgccaagacct

SEQ ID NO: 62636 - DNA, 15 bp, Artificial Sequence
  dgRNA
  C5ar1
ctcttaagggggtta

SEQ ID NO: 62637 - DNA, 15 bp, Artificial Sequence
  dgRNA
  C5ar1
tctcttaagggggtt

SEQ ID NO: 62638 - DNA, 15 bp, Artificial Sequence
  dgRNA
  C5ar1
cgttttctcttaagg

SEQ ID NO: 62639 - DNA, 15 bp, Artificial Sequence
  dgRNA
  Vmn1r34
tcctctatgtgctta

SEQ ID NO: 62640 - DNA, 15 bp, Artificial Sequence
  dgRNA
  Vmn1r34
accttaagcacatag

SEQ ID NO: 62641 - DNA, 15 bp, Artificial Sequence
  dgRNA
  Coq5
cgctgaaatataatt

SEQ ID NO: 62642 - DNA, 15 bp, Artificial Sequence
  dgRNA
  Coq5
aaaaaacaggcgttt

SEQ ID NO: 62643 - DNA, 15 bp, Artificial Sequence
  dgRNA
  Coq5
aaaaacaggcgtttg

SEQ ID NO: 62644 - DNA, 15 bp, Artificial Sequence
  dgRNA
  Coq5
aaaacaggcgtttgg

SEQ ID NO: 62645 - DNA, 15 bp, Artificial Sequence
  dgRNA
  P3h3
cactccgtctcactt

SEQ ID NO: 62646 - DNA, 15 bp, Artificial Sequence
  dgRNA
  P3h3
cacttcggttttccc

SEQ ID NO: 62647 - DNA, 15 bp, Artificial Sequence
  dgRNA
  P3h3
acttcggttttccca

SEQ ID NO: 62648 - DNA, 15 bp, Artificial Sequence
  dgRNA
  P3h3
aggcctaaatccagc

SEQ ID NO: 62649 - DNA, 15 bp, Artificial Sequence
  dgRNA
  Cox17
ctgacgccacgccct

SEQ ID NO: 62650 - DNA, 15 bp, Artificial Sequence
  dgRNA
  Cox17
cacgcccttggagcg

SEQ ID NO: 62651 - DNA, 15 bp, Artificial Sequence
  dgRNA
  Cox17
agacttacttccgtc

SEQ ID NO: 62652 - DNA, 15 bp, Artificial Sequence
  dgRNA
  Cox17
tacttccgtccggag

SEQ ID NO: 62653 - DNA, 15 bp, Artificial Sequence
  dgRNA
  Gm1553
ggtatgttctaaatt

SEQ ID NO: 62654 - DNA, 15 bp, Artificial Sequence
  dgRNA
  Gm1553
aggaccaaatcttag

SEQ ID NO: 62655 - DNA, 15 bp, Artificial Sequence
  dgRNA
  Gm1553
caccatatcacttag

SEQ ID NO: 62656 - DNA, 15 bp, Artificial Sequence
  dgRNA
  Gm1553
gtgatatggtgagct

SEQ ID NO: 62657 - DNA, 15 bp, Artificial Sequence
  dgRNA
  Ms4a15
ctcggacactagtag

SEQ ID NO: 62658 - DNA, 15 bp, Artificial Sequence
  dgRNA
  Ms4a15
tcggacactagtagt

SEQ ID NO: 62659 - DNA, 15 bp, Artificial Sequence
  dgRNA
  Ms4a15
gggtgcggacccata

SEQ ID NO: 62660 - DNA, 15 bp, Artificial Sequence
  dgRNA
  Ms4a15
ctagtgtccgagcta

SEQ ID NO: 62661 - DNA, 15 bp, Artificial Sequence
  dgRNA
  Gm5483
gaaatactacattag

SEQ ID NO: 62662 - DNA, 15 bp, Artificial Sequence
  dgRNA
  Gm5483
atactacattagagg

SEQ ID NO: 62663 - DNA, 15 bp, Artificial Sequence
  dgRNA
  Thnsl2
caaaggctagtgttc

SEQ ID NO: 62664 - DNA, 15 bp, Artificial Sequence
  dgRNA
  Thnsl2
gaagggacttcgggg

SEQ ID NO: 62665 - DNA, 15 bp, Artificial Sequence
  dgRNA
  Thnsl2
tcctacagagggcgg

SEQ ID NO: 62666 - DNA, 15 bp, Artificial Sequence
  dgRNA
  Thnsl2
aggagctcctacaga

SEQ ID NO: 62667 - DNA, 15 bp, Artificial Sequence
  dgRNA
  Tmem37
tgctgatagttcccg

SEQ ID NO: 62668 - DNA, 15 bp, Artificial Sequence
  dgRNA
  Tmem37
gttcccgaggggact

SEQ ID NO: 62669 - DNA, 15 bp, Artificial Sequence
  dgRNA
  Tmem37
gcggtgttaaactag

SEQ ID NO: 62670 - DNA, 15 bp, Artificial Sequence
  dgRNA
  Tmem37
acactaggtcaaatg

SEQ ID NO: 62671 - DNA, 15 bp, Artificial Sequence
  dgRNA
  Card14
gctcgctatagtctt

SEQ ID NO: 62672 - DNA, 15 bp, Artificial Sequence
  dgRNA
  Card14
tatagtctttggcgc

SEQ ID NO: 62673 - DNA, 15 bp, Artificial Sequence
  dgRNA
  Card14
ttggagcacgtcaca

SEQ ID NO: 62674 - DNA, 15 bp, Artificial Sequence
  dgRNA
  Card14
aagactatagcgagc

SEQ ID NO: 62675 - DNA, 15 bp, Artificial Sequence
  dgRNA
  Cdk5rap1
aagtagtaggtctca

SEQ ID NO: 62676 - DNA, 15 bp, Artificial Sequence
  dgRNA
  Cdk5rap1
cctgggactcgaagc

SEQ ID NO: 62677 - DNA, 15 bp, Artificial Sequence
  dgRNA
  Cdk5rap1
ggactcgaagccggc

SEQ ID NO: 62678 - DNA, 15 bp, Artificial Sequence
  dgRNA
  Cdk5rap1
accattagaacaccg

SEQ ID NO: 62679 - DNA, 15 bp, Artificial Sequence
  dgRNA
  Kcnq3
ccacccgacctcctc

SEQ ID NO: 62680 - DNA, 15 bp, Artificial Sequence
  dgRNA
  Kcnq3
cctctggcccccggg

SEQ ID NO: 62681 - DNA, 15 bp, Artificial Sequence
  dgRNA
  Kcnq3
ggggcgcgcggatca

SEQ ID NO: 62682 - DNA, 15 bp, Artificial Sequence
  dgRNA
  Kcnq3
cgcggatcatggcat

SEQ ID NO: 62683 - DNA, 15 bp, Artificial Sequence
  dgRNA
  Gja1
aactttatcttgacc

SEQ ID NO: 62684 - DNA, 15 bp, Artificial Sequence
  dgRNA
  Gja1
acgtcagctactgcg

SEQ ID NO: 62685 - DNA, 15 bp, Artificial Sequence
  dgRNA
  Gja1
tacgtcagctactgc

SEQ ID NO: 62686 - DNA, 15 bp, Artificial Sequence
  dgRNA
  Gja1
gtacgtcagctactg

SEQ ID NO: 62687 - DNA, 15 bp, Artificial Sequence
  dgRNA
  Unc5b
atcctgcgttcttca

SEQ ID NO: 62688 - DNA, 15 bp, Artificial Sequence
  dgRNA
  Unc5b
ggatcccctctgata

SEQ ID NO: 62689 - DNA, 15 bp, Artificial Sequence
  dgRNA
  Unc5b
gataaggccccaact

SEQ ID NO: 62690 - DNA, 15 bp, Artificial Sequence
  dgRNA
  Unc5b
gccgcgcctacacag

SEQ ID NO: 62691 - DNA, 15 bp, Artificial Sequence
  dgRNA
  Hlcs
cccacgtgacacata

SEQ ID NO: 62692 - DNA, 15 bp, Artificial Sequence
  dgRNA
  Hlcs
ccacgtgacacatat

SEQ ID NO: 62693 - DNA, 15 bp, Artificial Sequence
  dgRNA
  Hlcs
ttctccggctgctgg

SEQ ID NO: 62694 - DNA, 15 bp, Artificial Sequence
  dgRNA
  Hlcs
tccttctccggctgc

SEQ ID NO: 62695 - DNA, 15 bp, Artificial Sequence
  dgRNA
  Mrps5
gtctcattcaccccc

SEQ ID NO: 62696 - DNA, 15 bp, Artificial Sequence
  dgRNA
  Mrps5
ggtcaagcctgctac

SEQ ID NO: 62697 - DNA, 15 bp, Artificial Sequence
  dgRNA
  Mrps5
gagatgtgatccatt

SEQ ID NO: 62698 - DNA, 15 bp, Artificial Sequence
  dgRNA
  Mrps5
cggggtcctagcgcg

SEQ ID NO: 62699 - DNA, 15 bp, Artificial Sequence
  dgRNA
  Abhd12b
atcacctgcttgtct

SEQ ID NO: 62700 - DNA, 15 bp, Artificial Sequence
  dgRNA
  Abhd12b
ggtaagcctggtccc

SEQ ID NO: 62701 - DNA, 15 bp, Artificial Sequence
  dgRNA
  Abhd12b
catacccagacaagc

SEQ ID NO: 62702 - DNA, 15 bp, Artificial Sequence
  dgRNA
  Abhd12b
tcacacccattgcag

SEQ ID NO: 62703 - DNA, 15 bp, Artificial Sequence
  dgRNA
  Thoc6
ccgtgggtcccgact

SEQ ID NO: 62704 - DNA, 15 bp, Artificial Sequence
  dgRNA
  Thoc6
cgtgggtcccgactt

SEQ ID NO: 62705 - DNA, 15 bp, Artificial Sequence
  dgRNA
  Thoc6
gtgggtcccgacttg

SEQ ID NO: 62706 - DNA, 15 bp, Artificial Sequence
  dgRNA
  Thoc6
tgggtcccgacttgg

SEQ ID NO: 62707 - DNA, 15 bp, Artificial Sequence
  dgRNA
  Lipf
gatgtccagatatga

SEQ ID NO: 62708 - DNA, 15 bp, Artificial Sequence
  dgRNA
  Lipf
taggtccttcatatc

SEQ ID NO: 62709 - DNA, 15 bp, Artificial Sequence
  dgRNA
  Lipf
taatcaaactatctt

SEQ ID NO: 62710 - DNA, 15 bp, Artificial Sequence
  dgRNA
  Cyp2c40
gcccagatgtcttac

SEQ ID NO: 62711 - DNA, 15 bp, Artificial Sequence
  dgRNA
  Gpc4
tgctcccgcctgtct

SEQ ID NO: 62712 - DNA, 15 bp, Artificial Sequence
  dgRNA
  Gpc4
gctcccgcctgtctc

SEQ ID NO: 62713 - DNA, 15 bp, Artificial Sequence
  dgRNA
  Gpc4
tagggccgccccgct

SEQ ID NO: 62714 - DNA, 15 bp, Artificial Sequence
  dgRNA
  Gpc4
gcttggccaagtttg

SEQ ID NO: 62715 - DNA, 15 bp, Artificial Sequence
  dgRNA
  Ankrd52
tgcggaacccgcgcg

SEQ ID NO: 62716 - DNA, 15 bp, Artificial Sequence
  dgRNA
  Ankrd52
gcggaacccgcgcgc

SEQ ID NO: 62717 - DNA, 15 bp, Artificial Sequence
  dgRNA
  Ankrd52
cggaacccgcgcgcg

SEQ ID NO: 62718 - DNA, 15 bp, Artificial Sequence
  dgRNA
  Ankrd52
acccgcgcgcggggt

SEQ ID NO: 62719 - DNA, 15 bp, Artificial Sequence
  dgRNA
  Pkd2
aacccagggggagta

SEQ ID NO: 62720 - DNA, 15 bp, Artificial Sequence
  dgRNA
  Pkd2
ctaagcactatctta

SEQ ID NO: 62721 - DNA, 15 bp, Artificial Sequence
  dgRNA
  Pkd2
atcttaaggtcatgc

SEQ ID NO: 62722 - DNA, 15 bp, Artificial Sequence
  dgRNA
  Pkd2
cctttcccgacgagc

SEQ ID NO: 62723 - DNA, 15 bp, Artificial Sequence
  dgRNA
  Narf
tctcattggcttaag

SEQ ID NO: 62724 - DNA, 15 bp, Artificial Sequence
  dgRNA
  Narf
cattggcttaagcgg

SEQ ID NO: 62725 - DNA, 15 bp, Artificial Sequence
  dgRNA
  Narf
tggcttaagcggcgg

SEQ ID NO: 62726 - DNA, 15 bp, Artificial Sequence
  dgRNA
  Narf
cttaagcggcggagg

SEQ ID NO: 62727 - DNA, 15 bp, Artificial Sequence
  dgRNA
  Zg16
cttgtttattgtgcg

SEQ ID NO: 62728 - DNA, 15 bp, Artificial Sequence
  dgRNA
  Bag2
gtagagactgcccta

SEQ ID NO: 62729 - DNA, 15 bp, Artificial Sequence
  dgRNA
  Bag2
tgccctagggtgcac

SEQ ID NO: 62730 - DNA, 15 bp, Artificial Sequence
  dgRNA
  Bag2
ccttgctgtgaaccg

SEQ ID NO: 62731 - DNA, 15 bp, Artificial Sequence
  dgRNA
  Bag2
gtgaaccgtgggtgc

SEQ ID NO: 62732 - DNA, 15 bp, Artificial Sequence
  dgRNA
  Aldh1l1
cctcaccccattcta

SEQ ID NO: 62733 - DNA, 15 bp, Artificial Sequence
  dgRNA
  Aldh1l1
gaaagatctcctgat

SEQ ID NO: 62734 - DNA, 15 bp, Artificial Sequence
  dgRNA
  Aldh1l1
ctgattggtcatatc

SEQ ID NO: 62735 - DNA, 15 bp, Artificial Sequence
  dgRNA
  Aldh1l1
tgattggtcatatct

SEQ ID NO: 62736 - DNA, 15 bp, Artificial Sequence
  dgRNA
  Dpcr1
cggtctcccattatc

SEQ ID NO: 62737 - DNA, 15 bp, Artificial Sequence
  dgRNA
  Dpcr1
atcagggcgcccctg

SEQ ID NO: 62738 - DNA, 15 bp, Artificial Sequence
  dgRNA
  Dpcr1
tcagggcgcccctgt

SEQ ID NO: 62739 - DNA, 15 bp, Artificial Sequence
  dgRNA
  Dpcr1
cagggcgcccctgtg

SEQ ID NO: 62740 - DNA, 15 bp, Artificial Sequence
  dgRNA
  Zfp420
gaaagaggagcggtt

SEQ ID NO: 62741 - DNA, 15 bp, Artificial Sequence
  dgRNA
  Zfp420
gccgtttccgtttcc

SEQ ID NO: 62742 - DNA, 15 bp, Artificial Sequence
  dgRNA
  Zfp420
gtagtccaatggctg

SEQ ID NO: 62743 - DNA, 15 bp, Artificial Sequence
  dgRNA
  Zfp420
tgtagtccaatggct

SEQ ID NO: 62744 - DNA, 15 bp, Artificial Sequence
  dgRNA
  Npy1r
cgagttgtgcatccg

SEQ ID NO: 62745 - DNA, 15 bp, Artificial Sequence
  dgRNA
  Npy1r
gtgcatccgaggtgt

SEQ ID NO: 62746 - DNA, 15 bp, Artificial Sequence
  dgRNA
  Npy1r
tgcatccgaggtgtt

SEQ ID NO: 62747 - DNA, 15 bp, Artificial Sequence
  dgRNA
  Npy1r
atccgaggtgttggg

SEQ ID NO: 62748 - DNA, 15 bp, Artificial Sequence
  dgRNA
  Slc26a11
caggtggccgtgcca

SEQ ID NO: 62749 - DNA, 15 bp, Artificial Sequence
  dgRNA
  Slc26a11
ccgtgccagggacgg

SEQ ID NO: 62750 - DNA, 15 bp, Artificial Sequence
  dgRNA
  Slc26a11
gcgccgcagagtccc

SEQ ID NO: 62751 - DNA, 15 bp, Artificial Sequence
  dgRNA
  Slc26a11
gtcccgggcagtgca

SEQ ID NO: 62752 - DNA, 15 bp, Artificial Sequence
  dgRNA
  Hoxb9
ccgattgatttatgt

SEQ ID NO: 62753 - DNA, 15 bp, Artificial Sequence
  dgRNA
  Hoxb9
agctgacgctttatc

SEQ ID NO: 62754 - DNA, 15 bp, Artificial Sequence
  dgRNA
  Hoxb9
accaatcattttgca

SEQ ID NO: 62755 - DNA, 15 bp, Artificial Sequence
  dgRNA
  Hoxb9
caaggagctccgagc

SEQ ID NO: 62756 - DNA, 15 bp, Artificial Sequence
  dgRNA
  Tbl1x
cgctgtcgaccctct

SEQ ID NO: 62757 - DNA, 15 bp, Artificial Sequence
  dgRNA
  Tbl1x
cgcgtccgctcccag

SEQ ID NO: 62758 - DNA, 15 bp, Artificial Sequence
  dgRNA
  Tbl1x
gtccgctcccagcgg

SEQ ID NO: 62759 - DNA, 15 bp, Artificial Sequence
  dgRNA
  Tbl1x
cccagcggaggtcac

SEQ ID NO: 62760 - DNA, 15 bp, Artificial Sequence
  dgRNA
  Tinag
tactggagcctttta

SEQ ID NO: 62761 - DNA, 15 bp, Artificial Sequence
  dgRNA
  Ankk1
gggcatgcccctctc

SEQ ID NO: 62762 - DNA, 15 bp, Artificial Sequence
  dgRNA
  Ankk1
cccgaggctgcagaa

SEQ ID NO: 62763 - DNA, 15 bp, Artificial Sequence
  dgRNA
  Ankk1
tcttccgccaaggtg

SEQ ID NO: 62764 - DNA, 15 bp, Artificial Sequence
  dgRNA
  Ankk1
ttcttccgccaaggt

SEQ ID NO: 62765 - DNA, 15 bp, Artificial Sequence
  dgRNA
  Rbms3
tcatccggactggac

SEQ ID NO: 62766 - DNA, 15 bp, Artificial Sequence
  dgRNA
  Rbms3
catccggactggacc

SEQ ID NO: 62767 - DNA, 15 bp, Artificial Sequence
  dgRNA
  Rbms3
ctgcccggtccagtc

SEQ ID NO: 62768 - DNA, 15 bp, Artificial Sequence
  dgRNA
  Foxh1
gcagatagggtattc

SEQ ID NO: 62769 - DNA, 15 bp, Artificial Sequence
  dgRNA
  Foxh1
cagatagggtattct

SEQ ID NO: 62770 - DNA, 15 bp, Artificial Sequence
  dgRNA
  Foxh1
ggtagacctctttca

SEQ ID NO: 62771 - DNA, 15 bp, Artificial Sequence
  dgRNA
  Foxh1
gtagacctctttcaa

SEQ ID NO: 62772 - DNA, 15 bp, Artificial Sequence
  dgRNA
  Gm17359
gtgatagagcccttt

SEQ ID NO: 62773 - DNA, 15 bp, Artificial Sequence
  dgRNA
  Gm17359
cctttaggctgttgt

SEQ ID NO: 62774 - DNA, 15 bp, Artificial Sequence
  dgRNA
  Gm17359
tagacaagattcttc

SEQ ID NO: 62775 - DNA, 15 bp, Artificial Sequence
  dgRNA
  Gm17359
gtcatcaagcatcct

SEQ ID NO: 62776 - DNA, 15 bp, Artificial Sequence
  dgRNA
  Cep57l1
tactacaacgtcaac

SEQ ID NO: 62777 - DNA, 15 bp, Artificial Sequence
  dgRNA
  Cep57l1
actgatcccatctga

SEQ ID NO: 62778 - DNA, 15 bp, Artificial Sequence
  dgRNA
  Tbc1d12
cgccgtcaagtgata

SEQ ID NO: 62779 - DNA, 15 bp, Artificial Sequence
  dgRNA
  Tbc1d12
taagcactgtcaccc

SEQ ID NO: 62780 - DNA, 15 bp, Artificial Sequence
  dgRNA
  Tbc1d12
gcactgtcacccggg

SEQ ID NO: 62781 - DNA, 15 bp, Artificial Sequence
  dgRNA
  Tbc1d12
ctgtcacccgggtgg

SEQ ID NO: 62782 - DNA, 15 bp, Artificial Sequence
  dgRNA
  Spc24
gaagaaatttcgcac

SEQ ID NO: 62783 - DNA, 15 bp, Artificial Sequence
  dgRNA
  Spc24
ctgattgagtcctgc

SEQ ID NO: 62784 - DNA, 15 bp, Artificial Sequence
  dgRNA
  Spc24
gcaggagacggacgt

SEQ ID NO: 62785 - DNA, 15 bp, Artificial Sequence
  dgRNA
  Spc24
gagacttatgcgctc

SEQ ID NO: 62786 - DNA, 15 bp, Artificial Sequence
  dgRNA
  Dpp6
agtagtgtagtgcgc

SEQ ID NO: 62787 - DNA, 15 bp, Artificial Sequence
  dgRNA
  Dpp6
tgagcgcacgcatgc

SEQ ID NO: 62788 - DNA, 15 bp, Artificial Sequence
  dgRNA
  Dpp6
gagcgcacgcatgcg

SEQ ID NO: 62789 - DNA, 15 bp, Artificial Sequence
  dgRNA
  Dpp6
cgcacgcatgcgggg

SEQ ID NO: 62790 - DNA, 15 bp, Artificial Sequence
  dgRNA
  Vwde
atatccaatacctgc

SEQ ID NO: 62791 - DNA, 15 bp, Artificial Sequence
  dgRNA
  Vwde
acctgctgggtgatc

SEQ ID NO: 62792 - DNA, 15 bp, Artificial Sequence
  dgRNA
  Vwde
tggacagcttgggcg

SEQ ID NO: 62793 - DNA, 15 bp, Artificial Sequence
  dgRNA
  Vwde
gcgtggctttcagag

SEQ ID NO: 62794 - DNA, 15 bp, Artificial Sequence
  dgRNA
  3-Sep
aagttcagggttata

SEQ ID NO: 62795 - DNA, 15 bp, Artificial Sequence
  dgRNA
  3-Sep
tagggttcagcacct

SEQ ID NO: 62796 - DNA, 15 bp, Artificial Sequence
  dgRNA
  3-Sep
gttcagcacctaggc

SEQ ID NO: 62797 - DNA, 15 bp, Artificial Sequence
  dgRNA
  3-Sep
cgaatcaagagaact

SEQ ID NO: 62798 - DNA, 15 bp, Artificial Sequence
  dgRNA
  Lypd4
aaaagggcgacacag

SEQ ID NO: 62799 - DNA, 15 bp, Artificial Sequence
  dgRNA
  Lypd4
gacacagtggcgaag

SEQ ID NO: 62800 - DNA, 15 bp, Artificial Sequence
  dgRNA
  Lypd4
gcgaagaggaacggc

SEQ ID NO: 62801 - DNA, 15 bp, Artificial Sequence
  dgRNA
  Lypd4
aacggccggctcgag

SEQ ID NO: 62802 - DNA, 15 bp, Artificial Sequence
  dgRNA
  Adcy4
gtcaggctccagaac

SEQ ID NO: 62803 - DNA, 15 bp, Artificial Sequence
  dgRNA
  Adcy4
ggctccagaacggga

SEQ ID NO: 62804 - DNA, 15 bp, Artificial Sequence
  dgRNA
  Adcy4
gctccagaacgggaa

SEQ ID NO: 62805 - DNA, 15 bp, Artificial Sequence
  dgRNA
  Adcy4
ctccagaacgggaag

SEQ ID NO: 62806 - DNA, 15 bp, Artificial Sequence
  dgRNA
  Prr7
gcgctgggatgccct

SEQ ID NO: 62807 - DNA, 15 bp, Artificial Sequence
  dgRNA
  Prr7
tgccgcgtctgcgtg

SEQ ID NO: 62808 - DNA, 15 bp, Artificial Sequence
  dgRNA
  Prr7
gcgtctgcgtgcggc

SEQ ID NO: 62809 - DNA, 15 bp, Artificial Sequence
  dgRNA
  Prr7
tctgcgtgcggcagg

SEQ ID NO: 62810 - DNA, 15 bp, Artificial Sequence
  dgRNA
  Rnase6
cctcttcgctgacat

SEQ ID NO: 62811 - DNA, 15 bp, Artificial Sequence
  dgRNA
  Rnase6
gttaaagagctcact

SEQ ID NO: 62812 - DNA, 15 bp, Artificial Sequence
  dgRNA
  Rnase6
gagctcactaggagg

SEQ ID NO: 62813 - DNA, 15 bp, Artificial Sequence
  dgRNA
  Rnase6
ccaatgtcagcgaag

SEQ ID NO: 62814 - DNA, 15 bp, Artificial Sequence
  dgRNA
  Trappc4
tcgagagagtacttc

SEQ ID NO: 62815 - DNA, 15 bp, Artificial Sequence
  dgRNA
  Trappc4
cgagagagtacttcc

SEQ ID NO: 62816 - DNA, 15 bp, Artificial Sequence
  dgRNA
  Trappc4
gagagagtacttccg

SEQ ID NO: 62817 - DNA, 15 bp, Artificial Sequence
  dgRNA
  Trappc4
gtacttccggggcaa

SEQ ID NO: 62818 - DNA, 15 bp, Artificial Sequence
  dgRNA
  Scgb2b24
tctatgcaactggga

SEQ ID NO: 62819 - DNA, 15 bp, Artificial Sequence
  dgRNA
  Scgb2b24
ctatgcaactgggaa

SEQ ID NO: 62820 - DNA, 15 bp, Artificial Sequence
  dgRNA
  Scgb2b24
ggtatgtcgagctct

SEQ ID NO: 62821 - DNA, 15 bp, Artificial Sequence
  dgRNA
  Scgb2b24
atgtcgagctcttgg

SEQ ID NO: 62822 - DNA, 15 bp, Artificial Sequence
  dgRNA
  Cited1
actcgcccacgagcc

SEQ ID NO: 62823 - DNA, 15 bp, Artificial Sequence
  dgRNA
  Cited1
aataatgctctaagc

SEQ ID NO: 62824 - DNA, 15 bp, Artificial Sequence
  dgRNA
  Cited1
aaagacgtgaaaatt

SEQ ID NO: 62825 - DNA, 15 bp, Artificial Sequence
  dgRNA
  Cited1
aagacgtgaaaattg

SEQ ID NO: 62826 - DNA, 15 bp, Artificial Sequence
  dgRNA
  Tbx6
ctagtgaagctgcga

SEQ ID NO: 62827 - DNA, 15 bp, Artificial Sequence
  dgRNA
  Tbx6
tatccggcctcctct

SEQ ID NO: 62828 - DNA, 15 bp, Artificial Sequence
  dgRNA
  Tbx6
ccccttctaggcccc

SEQ ID NO: 62829 - DNA, 15 bp, Artificial Sequence
  dgRNA
  Tbx6
cccttctaggcccca

SEQ ID NO: 62830 - DNA, 15 bp, Artificial Sequence
  dgRNA
  Tm2d3
gggcgtgtccgggcg

SEQ ID NO: 62831 - DNA, 15 bp, Artificial Sequence
  dgRNA
  Rpgrip1
tagtggagaaagtcc

SEQ ID NO: 62832 - DNA, 15 bp, Artificial Sequence
  dgRNA
  Rpgrip1
gttcagcacgcgatg

SEQ ID NO: 62833 - DNA, 15 bp, Artificial Sequence
  dgRNA
  Rpgrip1
ttcagcacgcgatga

SEQ ID NO: 62834 - DNA, 15 bp, Artificial Sequence
  dgRNA
  Rpgrip1
atcgcgtgctgaact

SEQ ID NO: 62835 - DNA, 15 bp, Artificial Sequence
  dgRNA
  Zcchc2
agcattaggaccgcg

SEQ ID NO: 62836 - DNA, 15 bp, Artificial Sequence
  dgRNA
  Zcchc2
gcattaggaccgcgc

SEQ ID NO: 62837 - DNA, 15 bp, Artificial Sequence
  dgRNA
  Zcchc2
agagagggcggctcc

SEQ ID NO: 62838 - DNA, 15 bp, Artificial Sequence
  dgRNA
  Zcchc2
gagggcggctcccgg

SEQ ID NO: 62839 - DNA, 15 bp, Artificial Sequence
  dgRNA
  Ssc4d
tcggctgtcctgcac

SEQ ID NO: 62840 - DNA, 15 bp, Artificial Sequence
  dgRNA
  Ssc4d
cggctgtcctgcaca

SEQ ID NO: 62841 - DNA, 15 bp, Artificial Sequence
  dgRNA
  Ssc4d
ggtgaggaaccactc

SEQ ID NO: 62842 - DNA, 15 bp, Artificial Sequence
  dgRNA
  Ssc4d
tcggtgcccttcctc

SEQ ID NO: 62843 - DNA, 15 bp, Artificial Sequence
  dgRNA
  Slc9a5
gttagttccattgct

SEQ ID NO: 62844 - DNA, 15 bp, Artificial Sequence
  dgRNA
  Slc9a5
cattgctaggagggc

SEQ ID NO: 62845 - DNA, 15 bp, Artificial Sequence
  dgRNA
  Slc9a5
tccgcctcagagcag

SEQ ID NO: 62846 - DNA, 15 bp, Artificial Sequence
  dgRNA
  Slc9a5
ctttagatttggtat

SEQ ID NO: 62847 - DNA, 15 bp, Artificial Sequence
  dgRNA
  Cckar
caccctgaatatgtc

SEQ ID NO: 62848 - DNA, 15 bp, Artificial Sequence
  dgRNA
  Cckar
accctgaatatgtct

SEQ ID NO: 62849 - DNA, 15 bp, Artificial Sequence
  dgRNA
  Cckar
gtctgggacaatgac

SEQ ID NO: 62850 - DNA, 15 bp, Artificial Sequence
  dgRNA
  Cckar
gtcccagacatattc

SEQ ID NO: 62851 - DNA, 15 bp, Artificial Sequence
  dgRNA
  Clspn
ttctaagccatagcg

SEQ ID NO: 62852 - DNA, 15 bp, Artificial Sequence
  dgRNA
  Clspn
tctaagccatagcgc

SEQ ID NO: 62853 - DNA, 15 bp, Artificial Sequence
  dgRNA
  Clspn
gcaaattacatttgc

SEQ ID NO: 62854 - DNA, 15 bp, Artificial Sequence
  dgRNA
  Clspn
caaattacatttgcc

SEQ ID NO: 62855 - DNA, 15 bp, Artificial Sequence
  dgRNA
  Entpd5
tagtgttttgttgac

SEQ ID NO: 62856 - DNA, 15 bp, Artificial Sequence
  dgRNA
  Entpd5
gataagcttctgaag

SEQ ID NO: 62857 - DNA, 15 bp, Artificial Sequence
  dgRNA
  Tax1bp1
tccttcccatttcgc

SEQ ID NO: 62858 - DNA, 15 bp, Artificial Sequence
  dgRNA
  Tax1bp1
acggactgtgttttg

SEQ ID NO: 62859 - DNA, 15 bp, Artificial Sequence
  dgRNA
  Tax1bp1
cagggaaaccactaa

SEQ ID NO: 62860 - DNA, 15 bp, Artificial Sequence
  dgRNA
  Tax1bp1
tttacagctagcgag

SEQ ID NO: 62861 - DNA, 15 bp, Artificial Sequence
  dgRNA
  Acan
gctagcatctgacgc

SEQ ID NO: 62862 - DNA, 15 bp, Artificial Sequence
  dgRNA
  Acan
ctgacgcaggtgccg

SEQ ID NO: 62863 - DNA, 15 bp, Artificial Sequence
  dgRNA
  Acan
tgacgcaggtgccga

SEQ ID NO: 62864 - DNA, 15 bp, Artificial Sequence
  dgRNA
  Acan
ggtgccgagggagtt

SEQ ID NO: 62865 - DNA, 15 bp, Artificial Sequence
  dgRNA
  Dnase1l1
agctacgcaagtcgt

SEQ ID NO: 62866 - DNA, 15 bp, Artificial Sequence
  dgRNA
  Dnase1l1
acgcaagtcgtaggc

SEQ ID NO: 62867 - DNA, 15 bp, Artificial Sequence
  dgRNA
  Dnase1l1
caagtcgtaggctgg

SEQ ID NO: 62868 - DNA, 15 bp, Artificial Sequence
  dgRNA
  Dnase1l1
cacccgatgtgtatc

SEQ ID NO: 62869 - DNA, 15 bp, Artificial Sequence
  dgRNA
  Anapc2
agcgccgcgccctgt

SEQ ID NO: 62870 - DNA, 15 bp, Artificial Sequence
  dgRNA
  Anapc2
gcgccgcgccctgtt

SEQ ID NO: 62871 - DNA, 15 bp, Artificial Sequence
  dgRNA
  Anapc2
cgccctgttgggtca

SEQ ID NO: 62872 - DNA, 15 bp, Artificial Sequence
  dgRNA
  Anapc2
ggtctgcaccgcgtc

SEQ ID NO: 62873 - DNA, 15 bp, Artificial Sequence
  dgRNA
  Mcc
ccaccctcgttccgc

SEQ ID NO: 62874 - DNA, 15 bp, Artificial Sequence
  dgRNA
  Mcc
tccgcaggtgccact

SEQ ID NO: 62875 - DNA, 15 bp, Artificial Sequence
  dgRNA
  Mcc
ccgcaggtgccactt

SEQ ID NO: 62876 - DNA, 15 bp, Artificial Sequence
  dgRNA
  Mcc
cacttgggcgattcc

SEQ ID NO: 62877 - DNA, 15 bp, Artificial Sequence
  dgRNA
  Papd7
tctgcctcaactcgc

SEQ ID NO: 62878 - DNA, 15 bp, Artificial Sequence
  dgRNA
  Papd7
tcaactcgccggcgc

SEQ ID NO: 62879 - DNA, 15 bp, Artificial Sequence
  dgRNA
  Papd7
cgccggcgctggaca

SEQ ID NO: 62880 - DNA, 15 bp, Artificial Sequence
  dgRNA
  Papd7
cggcgctggacacgg

SEQ ID NO: 62881 - DNA, 15 bp, Artificial Sequence
  dgRNA
  Tfip11
tccagtgcctggcga

SEQ ID NO: 62882 - DNA, 15 bp, Artificial Sequence
  dgRNA
  Tfip11
ggcgacggctcgccc

SEQ ID NO: 62883 - DNA, 15 bp, Artificial Sequence
  dgRNA
  Tfip11
cgccctggaacgaga

SEQ ID NO: 62884 - DNA, 15 bp, Artificial Sequence
  dgRNA
  Tfip11
cagcctcagttccga

SEQ ID NO: 62885 - DNA, 15 bp, Artificial Sequence
  dgRNA
  Mmp21
gacagggacgcagta

SEQ ID NO: 62886 - DNA, 15 bp, Artificial Sequence
  dgRNA
  Mmp21
gggacgcagtaaggt

SEQ ID NO: 62887 - DNA, 15 bp, Artificial Sequence
  dgRNA
  Mmp21
acgcagtaaggtagg

SEQ ID NO: 62888 - DNA, 15 bp, Artificial Sequence
  dgRNA
  Mmp21
cccctcctaaggagc

SEQ ID NO: 62889 - DNA, 15 bp, Artificial Sequence
  dgRNA
  Pi4kb
acgctacttccctct

SEQ ID NO: 62890 - DNA, 15 bp, Artificial Sequence
  dgRNA
  Pi4kb
cccgccctcaaacac

SEQ ID NO: 62891 - DNA, 15 bp, Artificial Sequence
  dgRNA
  Pi4kb
ccgccctcaaacaca

SEQ ID NO: 62892 - DNA, 15 bp, Artificial Sequence
  dgRNA
  Pi4kb
atcagtggagggacg

SEQ ID NO: 62893 - DNA, 15 bp, Artificial Sequence
  dgRNA
  Clcn5
cccctacccatttga

SEQ ID NO: 62894 - DNA, 15 bp, Artificial Sequence
  dgRNA
  Clcn5
gagactacatcttta

SEQ ID NO: 62895 - DNA, 15 bp, Artificial Sequence
  dgRNA
  Clcn5
tccaaggccggtcca

SEQ ID NO: 62896 - DNA, 15 bp, Artificial Sequence
  dgRNA
  Clcn5
ccaaggccggtccaa

SEQ ID NO: 62897 - DNA, 15 bp, Artificial Sequence
  dgRNA
  Pik3c2g
attcacgattattaa

SEQ ID NO: 62898 - DNA, 15 bp, Artificial Sequence
  dgRNA
  Pik3c2g
gagagggcagccgta

SEQ ID NO: 62899 - DNA, 15 bp, Artificial Sequence
  dgRNA
  Pik3c2g
agattcatttagtgg

SEQ ID NO: 62900 - DNA, 15 bp, Artificial Sequence
  dgRNA
  Pik3c2g
ctgagattcatttag

SEQ ID NO: 62901 - DNA, 15 bp, Artificial Sequence
  dgRNA
  Rnf217
gctgcccgcacgctg

SEQ ID NO: 62902 - DNA, 15 bp, Artificial Sequence
  dgRNA
  Rnf217
ccgcacgctgcggcc

SEQ ID NO: 62903 - DNA, 15 bp, Artificial Sequence
  dgRNA
  Rnf217
cgcacgctgcggccc

SEQ ID NO: 62904 - DNA, 15 bp, Artificial Sequence
  dgRNA
  Rnf217
tgcggcccgggagcc

SEQ ID NO: 62905 - DNA, 15 bp, Artificial Sequence
  dgRNA
  Tnk1
ggcaaggcaagcgga

SEQ ID NO: 62906 - DNA, 15 bp, Artificial Sequence
  dgRNA
  Tnk1
ttaaccacggcctag

SEQ ID NO: 62907 - DNA, 15 bp, Artificial Sequence
  dgRNA
  Tnk1
acctgtcctacaagt

SEQ ID NO: 62908 - DNA, 15 bp, Artificial Sequence
  dgRNA
  Tnk1
caccagggaattaat

SEQ ID NO: 62909 - DNA, 15 bp, Artificial Sequence
  dgRNA
  Colgalt2
ctctaatctgtcaat

SEQ ID NO: 62910 - DNA, 15 bp, Artificial Sequence
  dgRNA
  Colgalt2
tgcattataaagccc

SEQ ID NO: 62911 - DNA, 15 bp, Artificial Sequence
  dgRNA
  Colgalt2
gacgcgatgtatcca

SEQ ID NO: 62912 - DNA, 15 bp, Artificial Sequence
  dgRNA
  Colgalt2
tgacgcgatgtatcc

SEQ ID NO: 62913 - DNA, 15 bp, Artificial Sequence
  dgRNA
  Kras
cgcccgggcccgtcc

SEQ ID NO: 62914 - DNA, 15 bp, Artificial Sequence
  dgRNA
  Kras
cgccctcgctctcct

SEQ ID NO: 62915 - DNA, 15 bp, Artificial Sequence
  dgRNA
  Kras
gggctcccagcgctg

SEQ ID NO: 62916 - DNA, 15 bp, Artificial Sequence
  dgRNA
  Kras
tccctcccgcgcgcg

SEQ ID NO: 62917 - DNA, 15 bp, Artificial Sequence
  dgRNA
  Atf7ip2
acgcctccctcgcgc

SEQ ID NO: 62918 - DNA, 15 bp, Artificial Sequence
  dgRNA
  Atf7ip2
agggccaggcgactg

SEQ ID NO: 62919 - DNA, 15 bp, Artificial Sequence
  dgRNA
  Atf7ip2
ccttcgctctgtcat

SEQ ID NO: 62920 - DNA, 15 bp, Artificial Sequence
  dgRNA
  Atf7ip2
cgctctgtcattggc

SEQ ID NO: 62921 - DNA, 15 bp, Artificial Sequence
  dgRNA
  Sprn
ttatggctggcgaag

SEQ ID NO: 62922 - DNA, 15 bp, Artificial Sequence
  dgRNA
  Sprn
ccgtaagaatcgatg

SEQ ID NO: 62923 - DNA, 15 bp, Artificial Sequence
  dgRNA
  Sprn
taagaatcgatgcgg

SEQ ID NO: 62924 - DNA, 15 bp, Artificial Sequence
  dgRNA
  Sprn
aagaatcgatgcggt

SEQ ID NO: 62925 - DNA, 15 bp, Artificial Sequence
  dgRNA
  Adora1
agacggagggcgacg

SEQ ID NO: 62926 - DNA, 15 bp, Artificial Sequence
  dgRNA
  Adora1
gacggagggcgacga

SEQ ID NO: 62927 - DNA, 15 bp, Artificial Sequence
  dgRNA
  Adora1
acagggacagtaccg

SEQ ID NO: 62928 - DNA, 15 bp, Artificial Sequence
  dgRNA
  Adora1
tccggcctcgggaca

SEQ ID NO: 62929 - DNA, 15 bp, Artificial Sequence
  dgRNA
  Tas2r143
agttttgctgctagg

SEQ ID NO: 62930 - DNA, 15 bp, Artificial Sequence
  dgRNA
  Tas2r143
ttttgatcccaatag

SEQ ID NO: 62931 - DNA, 15 bp, Artificial Sequence
  dgRNA
  Tas2r143
atcccaatagtggtt

SEQ ID NO: 62932 - DNA, 15 bp, Artificial Sequence
  dgRNA
  Tas2r143
agtgtctcagcgctc

SEQ ID NO: 62933 - DNA, 15 bp, Artificial Sequence
  dgRNA
  Pid1
atccagtaccaactt

SEQ ID NO: 62934 - DNA, 15 bp, Artificial Sequence
  dgRNA
  Pid1
tccagtaccaactta

SEQ ID NO: 62935 - DNA, 15 bp, Artificial Sequence
  dgRNA
  Pid1
ccagtaccaacttag

SEQ ID NO: 62936 - DNA, 15 bp, Artificial Sequence
  dgRNA
  Pid1
cacagccccgggcgc

SEQ ID NO: 62937 - DNA, 15 bp, Artificial Sequence
  dgRNA
  Nap1l3
caacccaggtgcata

SEQ ID NO: 62938 - DNA, 15 bp, Artificial Sequence
  dgRNA
  Nap1l3
aacccaggtgcatat

SEQ ID NO: 62939 - DNA, 15 bp, Artificial Sequence
  dgRNA
  Nap1l3
aatggcgttagtctt

SEQ ID NO: 62940 - DNA, 15 bp, Artificial Sequence
  dgRNA
  Nap1l3
tcctctccgcaaata

SEQ ID NO: 62941 - DNA, 15 bp, Artificial Sequence
  dgRNA
  Gpbp1
cctcacgtcagcagc

SEQ ID NO: 62942 - DNA, 15 bp, Artificial Sequence
  dgRNA
  Gpbp1
ctcacgtcagcagca

SEQ ID NO: 62943 - DNA, 15 bp, Artificial Sequence
  dgRNA
  Gpbp1
gcagggggtaatccc

SEQ ID NO: 62944 - DNA, 15 bp, Artificial Sequence
  dgRNA
  Gpbp1
atccggaacgttcgg

SEQ ID NO: 62945 - DNA, 15 bp, Artificial Sequence
  dgRNA
  Efcab1
actgagctgaccaag

SEQ ID NO: 62946 - DNA, 15 bp, Artificial Sequence
  dgRNA
  Efcab1
acccagccgttgcca

SEQ ID NO: 62947 - DNA, 15 bp, Artificial Sequence
  dgRNA
  Efcab1
ggccgctttcacctg

SEQ ID NO: 62948 - DNA, 15 bp, Artificial Sequence
  dgRNA
  Efcab1
cctgaggcgttgcca

SEQ ID NO: 62949 - DNA, 15 bp, Artificial Sequence
  dgRNA
  Zfp449
tataagaccggaaat

SEQ ID NO: 62950 - DNA, 15 bp, Artificial Sequence
  dgRNA
  Zfp449
atgcagcttgaaact

SEQ ID NO: 62951 - DNA, 15 bp, Artificial Sequence
  dgRNA
  Zfp449
acgtcagcatcctag

SEQ ID NO: 62952 - DNA, 15 bp, Artificial Sequence
  dgRNA
  Zfp449
cgtcagcatcctagt

SEQ ID NO: 62953 - DNA, 15 bp, Artificial Sequence
  dgRNA
  Apol7c
gtcactctcttgagt

SEQ ID NO: 62954 - DNA, 15 bp, Artificial Sequence
  dgRNA
  Apol7c
ttgacctgacattct

SEQ ID NO: 62955 - DNA, 15 bp, Artificial Sequence
  dgRNA
  2310057N15Rik
catggcatccgtgac

SEQ ID NO: 62956 - DNA, 15 bp, Artificial Sequence
  dgRNA
  2310057N15Rik
tatactctcaaaagc

SEQ ID NO: 62957 - DNA, 15 bp, Artificial Sequence
  dgRNA
  Rbfox1
gctgcacatactgag

SEQ ID NO: 62958 - DNA, 15 bp, Artificial Sequence
  dgRNA
  Rbfox1
ggctgcacatactga

SEQ ID NO: 62959 - DNA, 15 bp, Artificial Sequence
  dgRNA
  Rbfox1
cgcagcataaagtca

SEQ ID NO: 62960 - DNA, 15 bp, Artificial Sequence
  dgRNA
  Rbfox1
ccgcagcataaagtc

SEQ ID NO: 62961 - DNA, 15 bp, Artificial Sequence
  dgRNA
  Gstz1
tccctccgtttgccg

SEQ ID NO: 62962 - DNA, 15 bp, Artificial Sequence
  dgRNA
  Gstz1
tttgccgcggagcgc

SEQ ID NO: 62963 - DNA, 15 bp, Artificial Sequence
  dgRNA
  Gstz1
ttgccgcggagcgcc

SEQ ID NO: 62964 - DNA, 15 bp, Artificial Sequence
  dgRNA
  Gstz1
ggagcgccgggcccc

SEQ ID NO: 62965 - DNA, 15 bp, Artificial Sequence
  dgRNA
  Prkag3
taactcatcccacct

SEQ ID NO: 62966 - DNA, 15 bp, Artificial Sequence
  dgRNA
  Prkag3
tgcgggaacagctgc

SEQ ID NO: 62967 - DNA, 15 bp, Artificial Sequence
  dgRNA
  Prkag3
ctcgaggatagagaa

SEQ ID NO: 62968 - DNA, 15 bp, Artificial Sequence
  dgRNA
  Prkag3
actcgaggatagaga

SEQ ID NO: 62969 - DNA, 15 bp, Artificial Sequence
  dgRNA
  Cpsf7
cacccgcgccagcgt

SEQ ID NO: 62970 - DNA, 15 bp, Artificial Sequence
  dgRNA
  Cpsf7
acccgcgccagcgtc

SEQ ID NO: 62971 - DNA, 15 bp, Artificial Sequence
  dgRNA
  Cpsf7
ccagcgtcgggatca

SEQ ID NO: 62972 - DNA, 15 bp, Artificial Sequence
  dgRNA
  Cpsf7
tatagcacagtaagc

SEQ ID NO: 62973 - DNA, 15 bp, Artificial Sequence
  dgRNA
  Snapc5
ggccaatttactgtg

SEQ ID NO: 62974 - DNA, 15 bp, Artificial Sequence
  dgRNA
  Snapc5
gccaatttactgtga

SEQ ID NO: 62975 - DNA, 15 bp, Artificial Sequence
  dgRNA
  Snapc5
tgtgagggattacca

SEQ ID NO: 62976 - DNA, 15 bp, Artificial Sequence
  dgRNA
  Snapc5
gtgagggattaccaa

SEQ ID NO: 62977 - DNA, 15 bp, Artificial Sequence
  dgRNA
  Rpsa
cgccccagctacttc

SEQ ID NO: 62978 - DNA, 15 bp, Artificial Sequence
  dgRNA
  Rpsa
cagctacttccggcc

SEQ ID NO: 62979 - DNA, 15 bp, Artificial Sequence
  dgRNA
  Rpsa
agctacttccggcct

SEQ ID NO: 62980 - DNA, 15 bp, Artificial Sequence
  dgRNA
  Rpsa
gctacttccggcctg

SEQ ID NO: 62981 - DNA, 15 bp, Artificial Sequence
  dgRNA
  Ropn1l
gccaagccgagaccc

SEQ ID NO: 62982 - DNA, 15 bp, Artificial Sequence
  dgRNA
  Ropn1l
ctggtcgagacctct

SEQ ID NO: 62983 - DNA, 15 bp, Artificial Sequence
  dgRNA
  Ropn1l
tggtcgagacctctt

SEQ ID NO: 62984 - DNA, 15 bp, Artificial Sequence
  dgRNA
  Ropn1l
ggtcgagacctcttg

SEQ ID NO: 62985 - DNA, 15 bp, Artificial Sequence
  dgRNA
  Caprin2
gaaataggcgggatt

SEQ ID NO: 62986 - DNA, 15 bp, Artificial Sequence
  dgRNA
  Caprin2
aaataggcgggattt

SEQ ID NO: 62987 - DNA, 15 bp, Artificial Sequence
  dgRNA
  Caprin2
tggtcgcgccgtgcg

SEQ ID NO: 62988 - DNA, 15 bp, Artificial Sequence
  dgRNA
  Caprin2
gttgcgcgcgccttg

SEQ ID NO: 62989 - DNA, 15 bp, Artificial Sequence
  dgRNA
  Cfap36
ttttcaagggccagg

SEQ ID NO: 62990 - DNA, 15 bp, Artificial Sequence
  dgRNA
  Cfap36
ggtctgaagaccgct

SEQ ID NO: 62991 - DNA, 15 bp, Artificial Sequence
  dgRNA
  Cfap36
agaccgctagggatg

SEQ ID NO: 62992 - DNA, 15 bp, Artificial Sequence
  dgRNA
  Cfap36
ccgctagggatgagg

SEQ ID NO: 62993 - DNA, 15 bp, Artificial Sequence
  dgRNA
  Art2b
acactactcccagaa

SEQ ID NO: 62994 - DNA, 15 bp, Artificial Sequence
  dgRNA
  Art2b
gtctatgtcgcatcc

SEQ ID NO: 62995 - DNA, 15 bp, Artificial Sequence
  dgRNA
  Ugt1a2
aattccgactttatc

SEQ ID NO: 62996 - DNA, 15 bp, Artificial Sequence
  dgRNA
  Ugt1a2
gattaatgtttacct

SEQ ID NO: 62997 - DNA, 15 bp, Artificial Sequence
  dgRNA
  Ugt1a2
cccttaactaagtgc

SEQ ID NO: 62998 - DNA, 15 bp, Artificial Sequence
  dgRNA
  Ugt1a2
actacaatggttttt

SEQ ID NO: 62999 - DNA, 15 bp, Artificial Sequence
  dgRNA
  Gm13889
gcggggcgcgccttc

SEQ ID NO: 63000 - DNA, 15 bp, Artificial Sequence
  dgRNA
  Gm13889
cttccggagcgtggc

SEQ ID NO: 63001 - DNA, 15 bp, Artificial Sequence
  dgRNA
  Gm13889
ccggagcgtggctgg

SEQ ID NO: 63002 - DNA, 15 bp, Artificial Sequence
  dgRNA
  Gm13889
cggagcgtggctggc

SEQ ID NO: 63003 - DNA, 15 bp, Artificial Sequence
  dgRNA
  Frmd5
aaccaccgcccgcga

SEQ ID NO: 63004 - DNA, 15 bp, Artificial Sequence
  dgRNA
  Frmd5
accaccgcccgcgaa

SEQ ID NO: 63005 - DNA, 15 bp, Artificial Sequence
  dgRNA
  Frmd5
cgaagggagcgagcc

SEQ ID NO: 63006 - DNA, 15 bp, Artificial Sequence
  dgRNA
  Frmd5
agcgagccagggctt

SEQ ID NO: 63007 - DNA, 15 bp, Artificial Sequence
  dgRNA
  Cwc25
tcaacagttggggcc

SEQ ID NO: 63008 - DNA, 15 bp, Artificial Sequence
  dgRNA
  Cwc25
ccaggggcttacgtg

SEQ ID NO: 63009 - DNA, 15 bp, Artificial Sequence
  dgRNA
  Cwc25
caccaaaactgacgg

SEQ ID NO: 63010 - DNA, 15 bp, Artificial Sequence
  dgRNA
  Cwc25
accaaaactgacgga

SEQ ID NO: 63011 - DNA, 15 bp, Artificial Sequence
  dgRNA
  Use1
attctccatccttcg

SEQ ID NO: 63012 - DNA, 15 bp, Artificial Sequence
  dgRNA
  Use1
gatttattaaagctc

SEQ ID NO: 63013 - DNA, 15 bp, Artificial Sequence
  dgRNA
  Use1
ggactggaaactagc

SEQ ID NO: 63014 - DNA, 15 bp, Artificial Sequence
  dgRNA
  Use1
ggaaactagcaggtc

SEQ ID NO: 63015 - DNA, 15 bp, Artificial Sequence
  dgRNA
  Pdha2
aaaaacctatctact

SEQ ID NO: 63016 - DNA, 15 bp, Artificial Sequence
  dgRNA
  Pdha2
gacctcgaatgcacc

SEQ ID NO: 63017 - DNA, 15 bp, Artificial Sequence
  dgRNA
  Pdha2
tagacaattcgatca

SEQ ID NO: 63018 - DNA, 15 bp, Artificial Sequence
  dgRNA
  Tdrd1
tctcagcgcggcctc

SEQ ID NO: 63019 - DNA, 15 bp, Artificial Sequence
  dgRNA
  Tdrd1
accaccaagcacctg

SEQ ID NO: 63020 - DNA, 15 bp, Artificial Sequence
  dgRNA
  Tdrd1
tcagagcagctccgc

SEQ ID NO: 63021 - DNA, 15 bp, Artificial Sequence
  dgRNA
  Tdrd1
aggctcggctgcact

SEQ ID NO: 63022 - DNA, 15 bp, Artificial Sequence
  dgRNA
  Slc12a9
gtcagaccctcacca

SEQ ID NO: 63023 - DNA, 15 bp, Artificial Sequence
  dgRNA
  Slc12a9
tcagaccctcaccat

SEQ ID NO: 63024 - DNA, 15 bp, Artificial Sequence
  dgRNA
  Slc12a9
tagcatcctggcaac

SEQ ID NO: 63025 - DNA, 15 bp, Artificial Sequence
  dgRNA
  Slc12a9
agcatcctggcaacg

SEQ ID NO: 63026 - DNA, 15 bp, Artificial Sequence
  dgRNA
  Prrt4
ggtgtttctcgggaa

SEQ ID NO: 63027 - DNA, 15 bp, Artificial Sequence
  dgRNA
  Prrt4
gaatggcgtgcttgt

SEQ ID NO: 63028 - DNA, 15 bp, Artificial Sequence
  dgRNA
  Prrt4
cactccgttgaaccc

SEQ ID NO: 63029 - DNA, 15 bp, Artificial Sequence
  dgRNA
  Prrt4
catgcaacagtagtc

SEQ ID NO: 63030 - DNA, 15 bp, Artificial Sequence
  dgRNA
  Cutal
ctgctgacccgctgc

SEQ ID NO: 63031 - DNA, 15 bp, Artificial Sequence
  dgRNA
  Cutal
agctggatagtgtcc

SEQ ID NO: 63032 - DNA, 15 bp, Artificial Sequence
  dgRNA
  Cutal
tcacggttactgcct

SEQ ID NO: 63033 - DNA, 15 bp, Artificial Sequence
  dgRNA
  Cutal
cacggttactgccta

SEQ ID NO: 63034 - DNA, 15 bp, Artificial Sequence
  dgRNA
  Olfr564
caaacttgtctttgc

SEQ ID NO: 63035 - DNA, 15 bp, Artificial Sequence
  dgRNA
  Olfr564
attcttatcatgctc

SEQ ID NO: 63036 - DNA, 15 bp, Artificial Sequence
  dgRNA
  Gal3st2
ctaacatggacggtg

SEQ ID NO: 63037 - DNA, 15 bp, Artificial Sequence
  dgRNA
  Gal3st2
agggctccacccccc

SEQ ID NO: 63038 - DNA, 15 bp, Artificial Sequence
  dgRNA
  Gal3st2
cccccctggtgatac

SEQ ID NO: 63039 - DNA, 15 bp, Artificial Sequence
  dgRNA
  Gal3st2
gtatcaccagggggg

SEQ ID NO: 63040 - DNA, 15 bp, Artificial Sequence
  dgRNA
  Phf21a
gccgtcgccgccggc

SEQ ID NO: 63041 - DNA, 15 bp, Artificial Sequence
  dgRNA
  Phf21a
ccggccggccgcccc

SEQ ID NO: 63042 - DNA, 15 bp, Artificial Sequence
  dgRNA
  Phf21a
cccgggaccccgcgc

SEQ ID NO: 63043 - DNA, 15 bp, Artificial Sequence
  dgRNA
  Phf21a
ggaccccgcgcgggc

SEQ ID NO: 63044 - DNA, 15 bp, Artificial Sequence
  dgRNA
  Ppib
gacatacccaatcag

SEQ ID NO: 63045 - DNA, 15 bp, Artificial Sequence
  dgRNA
  Ppib
cagagggctgtaacg

SEQ ID NO: 63046 - DNA, 15 bp, Artificial Sequence
  dgRNA
  Ppib
gcagcgcctaccact

SEQ ID NO: 63047 - DNA, 15 bp, Artificial Sequence
  dgRNA
  Ppib
tcggcgtcgctgcgc

SEQ ID NO: 63048 - DNA, 15 bp, Artificial Sequence
  dgRNA
  Rgs10
cgcgaggggagggac

SEQ ID NO: 63049 - DNA, 15 bp, Artificial Sequence
  dgRNA
  Rgs10
ggaccgggatgtgcg

SEQ ID NO: 63050 - DNA, 15 bp, Artificial Sequence
  dgRNA
  Rgs10
gaccgggatgtgcgc

SEQ ID NO: 63051 - DNA, 15 bp, Artificial Sequence
  dgRNA
  Rgs10
tgtgcgcgggagctg

SEQ ID NO: 63052 - DNA, 15 bp, Artificial Sequence
  dgRNA
  Ceacam18
aagacgtgcagccgt

SEQ ID NO: 63053 - DNA, 15 bp, Artificial Sequence
  dgRNA
  Ceacam18
agagtcctttctagg

SEQ ID NO: 63054 - DNA, 15 bp, Artificial Sequence
  dgRNA
  Ceacam18
gtgagggcagaccta

SEQ ID NO: 63055 - DNA, 15 bp, Artificial Sequence
  dgRNA
  Prss41
atcaattgaccgctc

SEQ ID NO: 63056 - DNA, 15 bp, Artificial Sequence
  dgRNA
  Prss41
agtcaagccgggaaa

SEQ ID NO: 63057 - DNA, 15 bp, Artificial Sequence
  dgRNA
  Prss41
caagccgggaaacgg

SEQ ID NO: 63058 - DNA, 15 bp, Artificial Sequence
  dgRNA
  Prss41
gacctgtcccctaga

SEQ ID NO: 63059 - DNA, 15 bp, Artificial Sequence
  dgRNA
  Atp8b5
catgcagttagcccc

SEQ ID NO: 63060 - DNA, 15 bp, Artificial Sequence
  dgRNA
  Atp8b5
cagttagcccctgga

SEQ ID NO: 63061 - DNA, 15 bp, Artificial Sequence
  dgRNA
  Atp8b5
gacttggccatctca

SEQ ID NO: 63062 - DNA, 15 bp, Artificial Sequence
  dgRNA
  Atp8b5
cgggagacgagctcg

SEQ ID NO: 63063 - DNA, 15 bp, Artificial Sequence
  dgRNA
  Wee1
ccgtcgtgagcttga

SEQ ID NO: 63064 - DNA, 15 bp, Artificial Sequence
  dgRNA
  Wee1
cgtcgtgagcttgac

SEQ ID NO: 63065 - DNA, 15 bp, Artificial Sequence
  dgRNA
  Wee1
gagcttgacgggcct

SEQ ID NO: 63066 - DNA, 15 bp, Artificial Sequence
  dgRNA
  Wee1
gagttgccgccgcgc

SEQ ID NO: 63067 - DNA, 15 bp, Artificial Sequence
  dgRNA
  Cxcl13
agctcagcaatattt

SEQ ID NO: 63068 - DNA, 15 bp, Artificial Sequence
  dgRNA
  Cxcl13
cagactccgagctaa

SEQ ID NO: 63069 - DNA, 15 bp, Artificial Sequence
  dgRNA
  Cd80
cccggtgctcagaac

SEQ ID NO: 63070 - DNA, 15 bp, Artificial Sequence
  dgRNA
  Cd80
tttgagttgccctca

SEQ ID NO: 63071 - DNA, 15 bp, Artificial Sequence
  dgRNA
  Cd80
ggattctgcttgcgg

SEQ ID NO: 63072 - DNA, 15 bp, Artificial Sequence
  dgRNA
  Cd80
aggattctgcttgcg

SEQ ID NO: 63073 - DNA, 15 bp, Artificial Sequence
  dgRNA
  4930538K18Rik
gcccgcggtgagccc

SEQ ID NO: 63074 - DNA, 15 bp, Artificial Sequence
  dgRNA
  4930538K18Rik
cccgcggtgagccca

SEQ ID NO: 63075 - DNA, 15 bp, Artificial Sequence
  dgRNA
  4930538K18Rik
gcggtgagcccaggg

SEQ ID NO: 63076 - DNA, 15 bp, Artificial Sequence
  dgRNA
  4930538K18Rik
agggtggctctatcc

SEQ ID NO: 63077 - DNA, 15 bp, Artificial Sequence
  dgRNA
  Oasl2
gaaagttactatttg

SEQ ID NO: 63078 - DNA, 15 bp, Artificial Sequence
  dgRNA
  Oasl2
ctaatcctacaccca

SEQ ID NO: 63079 - DNA, 15 bp, Artificial Sequence
  dgRNA
  Oasl2
catatcacactaccc

SEQ ID NO: 63080 - DNA, 15 bp, Artificial Sequence
  dgRNA
  Oasl2
cttgggtgtaggatt

SEQ ID NO: 63081 - DNA, 15 bp, Artificial Sequence
  dgRNA
  Pfn3
ccgccctgcgaactt

SEQ ID NO: 63082 - DNA, 15 bp, Artificial Sequence
  dgRNA
  Pfn3
cgccctgcgaacttc

SEQ ID NO: 63083 - DNA, 15 bp, Artificial Sequence
  dgRNA
  Pfn3
gcaagcacaagttgc

SEQ ID NO: 63084 - DNA, 15 bp, Artificial Sequence
  dgRNA
  Pfn3
caagcacaagttgct

SEQ ID NO: 63085 - DNA, 15 bp, Artificial Sequence
  dgRNA
  P3h2
aggggtcggcctctc

SEQ ID NO: 63086 - DNA, 15 bp, Artificial Sequence
  dgRNA
  P3h2
ctggagcgcggctcg

SEQ ID NO: 63087 - DNA, 15 bp, Artificial Sequence
  dgRNA
  P3h2
gagcgcggctcgcgg

SEQ ID NO: 63088 - DNA, 15 bp, Artificial Sequence
  dgRNA
  P3h2
cggctcgcggaggct

SEQ ID NO: 63089 - DNA, 15 bp, Artificial Sequence
  dgRNA
  Tmbim7
cgacagttaagggag

SEQ ID NO: 63090 - DNA, 15 bp, Artificial Sequence
  dgRNA
  Fam72a
tccaagttcacaggg

SEQ ID NO: 63091 - DNA, 15 bp, Artificial Sequence
  dgRNA
  Fam72a
aagccgagcagatgc

SEQ ID NO: 63092 - DNA, 15 bp, Artificial Sequence
  dgRNA
  Fam72a
tggccaatgatctta

SEQ ID NO: 63093 - DNA, 15 bp, Artificial Sequence
  dgRNA
  Fam72a
ggccaatgatcttag

SEQ ID NO: 63094 - DNA, 15 bp, Artificial Sequence
  dgRNA
  Pomgnt1
tctcgcgccccgccc

SEQ ID NO: 63095 - DNA, 15 bp, Artificial Sequence
  dgRNA
  Elovl5
caccgcatctgattc

SEQ ID NO: 63096 - DNA, 15 bp, Artificial Sequence
  dgRNA
  Elovl5
aagttctatcgcccc

SEQ ID NO: 63097 - DNA, 15 bp, Artificial Sequence
  dgRNA
  Elovl5
ctatcgccccaggat

SEQ ID NO: 63098 - DNA, 15 bp, Artificial Sequence
  dgRNA
  Elovl5
cctccgggctcggat

SEQ ID NO: 63099 - DNA, 15 bp, Artificial Sequence
  dgRNA
  Ccdc149
gtccccggggtgccg

SEQ ID NO: 63100 - DNA, 15 bp, Artificial Sequence
  dgRNA
  Ccdc149
tgccgcggctggcac

SEQ ID NO: 63101 - DNA, 15 bp, Artificial Sequence
  dgRNA
  Ccdc149
gccccgagccactgt

SEQ ID NO: 63102 - DNA, 15 bp, Artificial Sequence
  dgRNA
  Ccdc149
ccccgagccactgta

SEQ ID NO: 63103 - DNA, 15 bp, Artificial Sequence
  dgRNA
  Ccl22
tgacccctagtgata

SEQ ID NO: 63104 - DNA, 15 bp, Artificial Sequence
  dgRNA
  Ccl22
ggtagagcaccgcta

SEQ ID NO: 63105 - DNA, 15 bp, Artificial Sequence
  dgRNA
  Ccl22
gtagagcaccgctaa

SEQ ID NO: 63106 - DNA, 15 bp, Artificial Sequence
  dgRNA
  Ccl22
tagagcaccgctaag

SEQ ID NO: 63107 - DNA, 15 bp, Artificial Sequence
  dgRNA
  Ldhc
cctttaaagggatgc

SEQ ID NO: 63108 - DNA, 15 bp, Artificial Sequence
  dgRNA
  Ldhc
ggatgctggccaaac

SEQ ID NO: 63109 - DNA, 15 bp, Artificial Sequence
  dgRNA
  Ldhc
tacatcttacactag

SEQ ID NO: 63110 - DNA, 15 bp, Artificial Sequence
  dgRNA
  Ldhc
ttacactagaggcct

SEQ ID NO: 63111 - DNA, 15 bp, Artificial Sequence
  dgRNA
  Arl14epl
cggtaggatgtgtga

SEQ ID NO: 63112 - DNA, 15 bp, Artificial Sequence
  dgRNA
  Arl14epl
gtccttgatcaaatt

SEQ ID NO: 63113 - DNA, 15 bp, Artificial Sequence
  dgRNA
  Arl14epl
tccgttctacctgag

SEQ ID NO: 63114 - DNA, 15 bp, Artificial Sequence
  dgRNA
  Cilp2
cgtccgccgaaagtt

SEQ ID NO: 63115 - DNA, 15 bp, Artificial Sequence
  dgRNA
  Cilp2
cctgccaaaatatac

SEQ ID NO: 63116 - DNA, 15 bp, Artificial Sequence
  dgRNA
  Cilp2
ctggcaccgactgcg

SEQ ID NO: 63117 - DNA, 15 bp, Artificial Sequence
  dgRNA
  Cilp2
cctcttttgtgtacc

SEQ ID NO: 63118 - DNA, 15 bp, Artificial Sequence
  dgRNA
  Bloc1s5
gagtttagttcctac

SEQ ID NO: 63119 - DNA, 15 bp, Artificial Sequence
  dgRNA
  Bloc1s5
agttcctaccggcgt

SEQ ID NO: 63120 - DNA, 15 bp, Artificial Sequence
  dgRNA
  Bloc1s5
cctaccggcgtagga

SEQ ID NO: 63121 - DNA, 15 bp, Artificial Sequence
  dgRNA
  Bloc1s5
ctaccggcgtaggat

SEQ ID NO: 63122 - DNA, 15 bp, Artificial Sequence
  dgRNA
  Ccl9
agctaacctctcatc

SEQ ID NO: 63123 - DNA, 15 bp, Artificial Sequence
  dgRNA
  Ccl9
gctaacctctcatca

SEQ ID NO: 63124 - DNA, 15 bp, Artificial Sequence
  dgRNA
  Ccl9
catcaggggtctaga

SEQ ID NO: 63125 - DNA, 15 bp, Artificial Sequence
  dgRNA
  Ccl9
tagcttggaggacgc

SEQ ID NO: 63126 - DNA, 15 bp, Artificial Sequence
  dgRNA
  Rnft2
cggccggaagtcacg

SEQ ID NO: 63127 - DNA, 15 bp, Artificial Sequence
  dgRNA
  Rnft2
agtcacgtggcgccc

SEQ ID NO: 63128 - DNA, 15 bp, Artificial Sequence
  dgRNA
  Rnft2
cgccctggccacgcc

SEQ ID NO: 63129 - DNA, 15 bp, Artificial Sequence
  dgRNA
  Rnft2
gccctggccacgcca

SEQ ID NO: 63130 - DNA, 15 bp, Artificial Sequence
  dgRNA
  Lilra5
ggcagttgcctaagg

SEQ ID NO: 63131 - DNA, 15 bp, Artificial Sequence
  dgRNA
  Lilra5
tgatatttgtcgatc

SEQ ID NO: 63132 - DNA, 15 bp, Artificial Sequence
  dgRNA
  Lilra5
gacgtttagagaggc

SEQ ID NO: 63133 - DNA, 15 bp, Artificial Sequence
  dgRNA
  Lilra5
ggacgtttagagagg

SEQ ID NO: 63134 - DNA, 15 bp, Artificial Sequence
  dgRNA
  Pbld2
gcgtctaaacccagc

SEQ ID NO: 63135 - DNA, 15 bp, Artificial Sequence
  dgRNA
  Pbld2
attcccgtcctagcc

SEQ ID NO: 63136 - DNA, 15 bp, Artificial Sequence
  dgRNA
  Pbld2
ttcccgtcctagcct

SEQ ID NO: 63137 - DNA, 15 bp, Artificial Sequence
  dgRNA
  Pbld2
tcccgtcctagcctg

SEQ ID NO: 63138 - DNA, 15 bp, Artificial Sequence
  dgRNA
  Myl12b
gccctctgctaaatc

SEQ ID NO: 63139 - DNA, 15 bp, Artificial Sequence
  dgRNA
  Myl12b
taaatcaggcaactt

SEQ ID NO: 63140 - DNA, 15 bp, Artificial Sequence
  dgRNA
  Myl12b
cccgctgcaggcgcc

SEQ ID NO: 63141 - DNA, 15 bp, Artificial Sequence
  dgRNA
  Myl12b
ccgctgcaggcgcca

SEQ ID NO: 63142 - DNA, 15 bp, Artificial Sequence
  dgRNA
  Mettl18
actcccgccacagct

SEQ ID NO: 63143 - DNA, 15 bp, Artificial Sequence
  dgRNA
  Mettl18
gaacgccgtcccagc

SEQ ID NO: 63144 - DNA, 15 bp, Artificial Sequence
  dgRNA
  Mettl18
ctcgcccccaagcgt

SEQ ID NO: 63145 - DNA, 15 bp, Artificial Sequence
  dgRNA
  Mettl18
tcgcccccaagcgtc

SEQ ID NO: 63146 - DNA, 15 bp, Artificial Sequence
  dgRNA
  Fbxo31
acctaacacgtaggg

SEQ ID NO: 63147 - DNA, 15 bp, Artificial Sequence
  dgRNA
  Fbxo31
cctaacacgtagggc

SEQ ID NO: 63148 - DNA, 15 bp, Artificial Sequence
  dgRNA
  Fbxo31
ctaacacgtagggcg

SEQ ID NO: 63149 - DNA, 15 bp, Artificial Sequence
  dgRNA
  Fbxo31
ggggcctactgctca

SEQ ID NO: 63150 - DNA, 15 bp, Artificial Sequence
  dgRNA
  Gata1
gatccaacaacctgc

SEQ ID NO: 63151 - DNA, 15 bp, Artificial Sequence
  dgRNA
  Gata1
ggactagagcctaaa

SEQ ID NO: 63152 - DNA, 15 bp, Artificial Sequence
  dgRNA
  Gata1
aaaaggtcctccaca

SEQ ID NO: 63153 - DNA, 15 bp, Artificial Sequence
  dgRNA
  Gata1
aggtcctccacaagg

SEQ ID NO: 63154 - DNA, 15 bp, Artificial Sequence
  dgRNA
  Pip4k2b
cggtaccattccgac

SEQ ID NO: 63155 - DNA, 15 bp, Artificial Sequence
  dgRNA
  Pip4k2b
ggtaccattccgacg

SEQ ID NO: 63156 - DNA, 15 bp, Artificial Sequence
  dgRNA
  Pip4k2b
accattccgacgggg

SEQ ID NO: 63157 - DNA, 15 bp, Artificial Sequence
  dgRNA
  Pip4k2b
ccattccgacgggga

SEQ ID NO: 63158 - DNA, 15 bp, Artificial Sequence
  dgRNA
  Nudt16l1
cctctgcaacttgga

SEQ ID NO: 63159 - DNA, 15 bp, Artificial Sequence
  dgRNA
  Nudt16l1
ctgcaacttggaggg

SEQ ID NO: 63160 - DNA, 15 bp, Artificial Sequence
  dgRNA
  Nudt16l1
caccccgcctccgcc

SEQ ID NO: 63161 - DNA, 15 bp, Artificial Sequence
  dgRNA
  Nudt16l1
accccgcctccgcca

SEQ ID NO: 63162 - DNA, 15 bp, Artificial Sequence
  dgRNA
  Nkpd1
gcctgtccaaggtta

SEQ ID NO: 63163 - DNA, 15 bp, Artificial Sequence
  dgRNA
  Nkpd1
cctgtccaaggttac

SEQ ID NO: 63164 - DNA, 15 bp, Artificial Sequence
  dgRNA
  Nkpd1
ctgtccaaggttacg

SEQ ID NO: 63165 - DNA, 15 bp, Artificial Sequence
  dgRNA
  Nkpd1
tgtccaaggttacgg

SEQ ID NO: 63166 - DNA, 15 bp, Artificial Sequence
  dgRNA
  Dmgdh
tcgagtgcttccagc

SEQ ID NO: 63167 - DNA, 15 bp, Artificial Sequence
  dgRNA
  Dmgdh
tcgccgccgctgtac

SEQ ID NO: 63168 - DNA, 15 bp, Artificial Sequence
  dgRNA
  Dmgdh
gccgctgtacaggcg

SEQ ID NO: 63169 - DNA, 15 bp, Artificial Sequence
  dgRNA
  Dmgdh
ccgctgtacaggcgc

SEQ ID NO: 63170 - DNA, 15 bp, Artificial Sequence
  dgRNA
  Ice2
aactactgacgagtc

SEQ ID NO: 63171 - DNA, 15 bp, Artificial Sequence
  dgRNA
  Ice2
ggtcccttaacactg

SEQ ID NO: 63172 - DNA, 15 bp, Artificial Sequence
  dgRNA
  Ice2
tttgcattcgcgcgc

SEQ ID NO: 63173 - DNA, 15 bp, Artificial Sequence
  dgRNA
  Ice2
ccaggctgtaacttc

SEQ ID NO: 63174 - DNA, 15 bp, Artificial Sequence
  dgRNA
  Olfr1234
tgagtaaccaagcat

SEQ ID NO: 63175 - DNA, 15 bp, Artificial Sequence
  dgRNA
  Ankrd13c
cgaagctctcgcgag

SEQ ID NO: 63176 - DNA, 15 bp, Artificial Sequence
  dgRNA
  Ankrd13c
tctcgcgagaggagc

SEQ ID NO: 63177 - DNA, 15 bp, Artificial Sequence
  dgRNA
  Ankrd13c
ctcgcgagaggagcc

SEQ ID NO: 63178 - DNA, 15 bp, Artificial Sequence
  dgRNA
  Ankrd13c
tcgcgagaggagccg

SEQ ID NO: 63179 - DNA, 15 bp, Artificial Sequence
  dgRNA
  Pkd2l2
tgttaatactgcagg

SEQ ID NO: 63180 - DNA, 15 bp, Artificial Sequence
  dgRNA
  Pkd2l2
tgcgcaactctcagg

SEQ ID NO: 63181 - DNA, 15 bp, Artificial Sequence
  dgRNA
  Pkd2l2
gtgaagcgcgagcct

SEQ ID NO: 63182 - DNA, 15 bp, Artificial Sequence
  dgRNA
  Pkd2l2
aagcgcgagccttgg

SEQ ID NO: 63183 - DNA, 15 bp, Artificial Sequence
  dgRNA
  Ncoa1
aggggtcgcgctgcc

SEQ ID NO: 63184 - DNA, 15 bp, Artificial Sequence
  dgRNA
  Ncoa1
ggggtcgcgctgccc

SEQ ID NO: 63185 - DNA, 15 bp, Artificial Sequence
  dgRNA
  Ncoa1
gggtcgcgctgcccg

SEQ ID NO: 63186 - DNA, 15 bp, Artificial Sequence
  dgRNA
  Ncoa1
cccggggcgcgccgt

SEQ ID NO: 63187 - DNA, 15 bp, Artificial Sequence
  dgRNA
  Acsl6
agacaacatgtggtc

SEQ ID NO: 63188 - DNA, 15 bp, Artificial Sequence
  dgRNA
  Acsl6
gacaacatgtggtca

SEQ ID NO: 63189 - DNA, 15 bp, Artificial Sequence
  dgRNA
  Acsl6
taaggcctggttgct

SEQ ID NO: 63190 - DNA, 15 bp, Artificial Sequence
  dgRNA
  Acsl6
tctttagtctgggag

SEQ ID NO: 63191 - DNA, 15 bp, Artificial Sequence
  dgRNA
  Trappc2l
tgggccttacgggaa

SEQ ID NO: 63192 - DNA, 15 bp, Artificial Sequence
  dgRNA
  Trappc2l
gggccttacgggaaa

SEQ ID NO: 63193 - DNA, 15 bp, Artificial Sequence
  dgRNA
  Trappc2l
ggccttacgggaaag

SEQ ID NO: 63194 - DNA, 15 bp, Artificial Sequence
  dgRNA
  Trappc2l
cttacgggaaagggg

SEQ ID NO: 63195 - DNA, 15 bp, Artificial Sequence
  dgRNA
  Vmn1r212
tttctgctgttcgag

SEQ ID NO: 63196 - DNA, 15 bp, Artificial Sequence
  dgRNA
  Vmn1r212
agatagacatcgatc

SEQ ID NO: 63197 - DNA, 15 bp, Artificial Sequence
  dgRNA
  Zfp354c
ctttcagaacgcgcc

SEQ ID NO: 63198 - DNA, 15 bp, Artificial Sequence
  dgRNA
  Zfp354c
gaacgcgcctggccc

SEQ ID NO: 63199 - DNA, 15 bp, Artificial Sequence
  dgRNA
  Zfp354c
ggccccggtgccttc

SEQ ID NO: 63200 - DNA, 15 bp, Artificial Sequence
  dgRNA
  Zfp354c
gccccggtgccttct

SEQ ID NO: 63201 - DNA, 15 bp, Artificial Sequence
  dgRNA
  Glt8d1
ggcacggacaacccc

SEQ ID NO: 63202 - DNA, 15 bp, Artificial Sequence
  dgRNA
  Glt8d1
cccgcgccatcgaca

SEQ ID NO: 63203 - DNA, 15 bp, Artificial Sequence
  dgRNA
  Glt8d1
ccgcgccatcgacaa

SEQ ID NO: 63204 - DNA, 15 bp, Artificial Sequence
  dgRNA
  Glt8d1
cgccatcgacaaggg

SEQ ID NO: 63205 - DNA, 15 bp, Artificial Sequence
  dgRNA
  Cmc4
cgctcacgtccgcca

SEQ ID NO: 63206 - DNA, 15 bp, Artificial Sequence
  dgRNA
  Cmc4
gctcacgtccgccaa

SEQ ID NO: 63207 - DNA, 15 bp, Artificial Sequence
  dgRNA
  Cmc4
gcggctcgtccaacc

SEQ ID NO: 63208 - DNA, 15 bp, Artificial Sequence
  dgRNA
  Cmc4
cagcgcgggttccac

SEQ ID NO: 63209 - DNA, 15 bp, Artificial Sequence
  dgRNA
  Cldn2
caccaaggtttctcc

SEQ ID NO: 63210 - DNA, 15 bp, Artificial Sequence
  dgRNA
  Cldn2
gggggatttgggcca

SEQ ID NO: 63211 - DNA, 15 bp, Artificial Sequence
  dgRNA
  Cldn2
caaaaaacgtttggt

SEQ ID NO: 63212 - DNA, 15 bp, Artificial Sequence
  dgRNA
  Cldn2
acaaaaaacgtttgg

SEQ ID NO: 63213 - DNA, 15 bp, Artificial Sequence
  dgRNA
  Ctsb
catctctgtgcgaaa

SEQ ID NO: 63214 - DNA, 15 bp, Artificial Sequence
  dgRNA
  Ctsb
gtcccgggatgaagg

SEQ ID NO: 63215 - DNA, 15 bp, Artificial Sequence
  dgRNA
  Ctsb
atgcattcctcggga

SEQ ID NO: 63216 - DNA, 15 bp, Artificial Sequence
  dgRNA
  Ctsb
tgacatgcattcctc

SEQ ID NO: 63217 - DNA, 15 bp, Artificial Sequence
  dgRNA
  Rrad
tacctgccccgcccc

SEQ ID NO: 63218 - DNA, 15 bp, Artificial Sequence
  dgRNA
  Rrad
cccctggcgggtttg

SEQ ID NO: 63219 - DNA, 15 bp, Artificial Sequence
  dgRNA
  Rrad
tttgcggtcctagaa

SEQ ID NO: 63220 - DNA, 15 bp, Artificial Sequence
  dgRNA
  Rrad
gcggtcctagaaggg

SEQ ID NO: 63221 - DNA, 15 bp, Artificial Sequence
  dgRNA
  Dmrtc2
aactcgacgcgctat

SEQ ID NO: 63222 - DNA, 15 bp, Artificial Sequence
  dgRNA
  Dmrtc2
cgacgcgctattggc

SEQ ID NO: 63223 - DNA, 15 bp, Artificial Sequence
  dgRNA
  Dmrtc2
gcgtgattgttgccg

SEQ ID NO: 63224 - DNA, 15 bp, Artificial Sequence
  dgRNA
  Dmrtc2
gttgccgcggagaag

SEQ ID NO: 63225 - DNA, 15 bp, Artificial Sequence
  dgRNA
  Aqr
gtgattaataaaggt

SEQ ID NO: 63226 - DNA, 15 bp, Artificial Sequence
  dgRNA
  Aqr
taggattgggtcata

SEQ ID NO: 63227 - DNA, 15 bp, Artificial Sequence
  dgRNA
  Aqr
gtaggattgggtcat

SEQ ID NO: 63228 - DNA, 15 bp, Artificial Sequence
  dgRNA
  Aqr
acagcgtgtaggatt

SEQ ID NO: 63229 - DNA, 15 bp, Artificial Sequence
  dgRNA
  Rpl26
ccacgcacacctccg

SEQ ID NO: 63230 - DNA, 15 bp, Artificial Sequence
  dgRNA
  Rpl26
cacgcacacctccga

SEQ ID NO: 63231 - DNA, 15 bp, Artificial Sequence
  dgRNA
  Rpl26
ccgagggatgacgtc

SEQ ID NO: 63232 - DNA, 15 bp, Artificial Sequence
  dgRNA
  Rpl26
tctcgcgagatctcg

SEQ ID NO: 63233 - DNA, 15 bp, Artificial Sequence
  dgRNA
  Olfr61
ccctttctgacagca

SEQ ID NO: 63234 - DNA, 15 bp, Artificial Sequence
  dgRNA
  Olfr61
aaattgaggtgctca

SEQ ID NO: 63235 - DNA, 15 bp, Artificial Sequence
  dgRNA
  Olfr61
aaccagactttgcag

SEQ ID NO: 63236 - DNA, 15 bp, Artificial Sequence
  dgRNA
  Olfr532
ttactgtgaaacagc

SEQ ID NO: 63237 - DNA, 15 bp, Artificial Sequence
  dgRNA
  Dlg4
tagcccctggccgtt

SEQ ID NO: 63238 - DNA, 15 bp, Artificial Sequence
  dgRNA
  Dlg4
gacccccgcataccc

SEQ ID NO: 63239 - DNA, 15 bp, Artificial Sequence
  dgRNA
  Dlg4
acccccgcatacccc

SEQ ID NO: 63240 - DNA, 15 bp, Artificial Sequence
  dgRNA
  Dlg4
cccccgcataccccg

SEQ ID NO: 63241 - DNA, 15 bp, Artificial Sequence
  dgRNA
  Cyp8b1
gtttggccaggtaaa

SEQ ID NO: 63242 - DNA, 15 bp, Artificial Sequence
  dgRNA
  Cyp8b1
tagttagctggcaca

SEQ ID NO: 63243 - DNA, 15 bp, Artificial Sequence
  dgRNA
  Cyp8b1
ctagttagctggcac

SEQ ID NO: 63244 - DNA, 15 bp, Artificial Sequence
  dgRNA
  Cyp8b1
ataactctagttagc

SEQ ID NO: 63245 - DNA, 15 bp, Artificial Sequence
  dgRNA
  Twist2
ctggcctccgagatg

SEQ ID NO: 63246 - DNA, 15 bp, Artificial Sequence
  dgRNA
  Twist2
tggcctccgagatgc

SEQ ID NO: 63247 - DNA, 15 bp, Artificial Sequence
  dgRNA
  Twist2
atgcgggccacagtc

SEQ ID NO: 63248 - DNA, 15 bp, Artificial Sequence
  dgRNA
  Twist2
tgcgggccacagtca

SEQ ID NO: 63249 - DNA, 15 bp, Artificial Sequence
  dgRNA
  Mex3a
ggggagtcaggttac

SEQ ID NO: 63250 - DNA, 15 bp, Artificial Sequence
  dgRNA
  Mex3a
gttacagggtgcttg

SEQ ID NO: 63251 - DNA, 15 bp, Artificial Sequence
  dgRNA
  Mex3a
cgaaacaaaagctgg

SEQ ID NO: 63252 - DNA, 15 bp, Artificial Sequence
  dgRNA
  Mex3a
gcgaaacaaaagctg

SEQ ID NO: 63253 - DNA, 15 bp, Artificial Sequence
  dgRNA
  Ift46
agaaatccactagcc

SEQ ID NO: 63254 - DNA, 15 bp, Artificial Sequence
  dgRNA
  Ift46
caaccgactcagttg

SEQ ID NO: 63255 - DNA, 15 bp, Artificial Sequence
  dgRNA
  Ift46
agaccgcctagtgcc

SEQ ID NO: 63256 - DNA, 15 bp, Artificial Sequence
  dgRNA
  Ift46
gaccgcctagtgccc

SEQ ID NO: 63257 - DNA, 15 bp, Artificial Sequence
  dgRNA
  Nrp1
aaccgggaaagcacg

SEQ ID NO: 63258 - DNA, 15 bp, Artificial Sequence
  dgRNA
  Nrp1
agaggcgggtgccag

SEQ ID NO: 63259 - DNA, 15 bp, Artificial Sequence
  dgRNA
  Nrp1
cccggttggtcctct

SEQ ID NO: 63260 - DNA, 15 bp, Artificial Sequence
  dgRNA
  Nrp1
tcccggttggtcctc

SEQ ID NO: 63261 - DNA, 15 bp, Artificial Sequence
  dgRNA
  Aoc2
tggcagtcaaagttt

SEQ ID NO: 63262 - DNA, 15 bp, Artificial Sequence
  dgRNA
  Aoc2
ggcagtcaaagttta

SEQ ID NO: 63263 - DNA, 15 bp, Artificial Sequence
  dgRNA
  Aoc2
taaactccaccctgt

SEQ ID NO: 63264 - DNA, 15 bp, Artificial Sequence
  dgRNA
  Aoc2
ctaaactccaccctg

SEQ ID NO: 63265 - DNA, 15 bp, Artificial Sequence
  dgRNA
  Hoxa6
tgcccattaatctgc

SEQ ID NO: 63266 - DNA, 15 bp, Artificial Sequence
  dgRNA
  Hoxa6
gcccattaatctgcc

SEQ ID NO: 63267 - DNA, 15 bp, Artificial Sequence
  dgRNA
  Hoxa6
cattaatctgccggg

SEQ ID NO: 63268 - DNA, 15 bp, Artificial Sequence
  dgRNA
  Hoxa6
attaatctgccgggc

SEQ ID NO: 63269 - DNA, 15 bp, Artificial Sequence
  dgRNA
  BC003965
ccgccgcgccggatc

SEQ ID NO: 63270 - DNA, 15 bp, Artificial Sequence
  dgRNA
  BC003965
cggatcaggtctcaa

SEQ ID NO: 63271 - DNA, 15 bp, Artificial Sequence
  dgRNA
  BC003965
gtccagatagtgatc

SEQ ID NO: 63272 - DNA, 15 bp, Artificial Sequence
  dgRNA
  BC003965
tccagatagtgatca

SEQ ID NO: 63273 - DNA, 15 bp, Artificial Sequence
  dgRNA
  1700024P04Rik
tcagcaacaggtcgg

SEQ ID NO: 63274 - DNA, 15 bp, Artificial Sequence
  dgRNA
  1700024P04Rik
cacatcactataagt

SEQ ID NO: 63275 - DNA, 15 bp, Artificial Sequence
  dgRNA
  1700024P04Rik
gtagtacaaggactg

SEQ ID NO: 63276 - DNA, 15 bp, Artificial Sequence
  dgRNA
  1700024P04Rik
aaagtggctcccctt

SEQ ID NO: 63277 - DNA, 15 bp, Artificial Sequence
  dgRNA
  Olfr1351
agaaacggtggtatc

SEQ ID NO: 63278 - DNA, 15 bp, Artificial Sequence
  dgRNA
  Olfr1351
tatcaggtcattgat

SEQ ID NO: 63279 - DNA, 15 bp, Artificial Sequence
  dgRNA
  Olfr1351
taggtcaattagcat

SEQ ID NO: 63280 - DNA, 15 bp, Artificial Sequence
  dgRNA
  Olfr1351
agggctcaatttgaa

SEQ ID NO: 63281 - DNA, 15 bp, Artificial Sequence
  dgRNA
  Ids
tgtaaaatgtacgca

SEQ ID NO: 63282 - DNA, 15 bp, Artificial Sequence
  dgRNA
  Ids
cactgtttccggtta

SEQ ID NO: 63283 - DNA, 15 bp, Artificial Sequence
  dgRNA
  Ids
tcgtgctcagacgtc

SEQ ID NO: 63284 - DNA, 15 bp, Artificial Sequence
  dgRNA
  Ids
acgtccggcgccatc

SEQ ID NO: 63285 - DNA, 15 bp, Artificial Sequence
  dgRNA
  Mtus1
gacattaggcatgtg

SEQ ID NO: 63286 - DNA, 15 bp, Artificial Sequence
  dgRNA
  Mtus1
attaggcatgtgagg

SEQ ID NO: 63287 - DNA, 15 bp, Artificial Sequence
  dgRNA
  Mtus1
gttccaaatagtgac

SEQ ID NO: 63288 - DNA, 15 bp, Artificial Sequence
  dgRNA
  Mtus1
gacctgcgacatcat

SEQ ID NO: 63289 - DNA, 15 bp, Artificial Sequence
  dgRNA
  Sucla2
tctattgtatcctaa

SEQ ID NO: 63290 - DNA, 15 bp, Artificial Sequence
  dgRNA
  Sucla2
acttgtgaggccact

SEQ ID NO: 63291 - DNA, 15 bp, Artificial Sequence
  dgRNA
  Sucla2
cttgtgaggccacta

SEQ ID NO: 63292 - DNA, 15 bp, Artificial Sequence
  dgRNA
  Sucla2
gcgtcacagttctct

SEQ ID NO: 63293 - DNA, 15 bp, Artificial Sequence
  dgRNA
  Vps33b
gctctaatcgctaac

SEQ ID NO: 63294 - DNA, 15 bp, Artificial Sequence
  dgRNA
  Vps33b
ctctaatcgctaact

SEQ ID NO: 63295 - DNA, 15 bp, Artificial Sequence
  dgRNA
  Vps33b
gctaactgggagacc

SEQ ID NO: 63296 - DNA, 15 bp, Artificial Sequence
  dgRNA
  Vps33b
ggagacccggacttc

SEQ ID NO: 63297 - DNA, 15 bp, Artificial Sequence
  dgRNA
  Atpif1
cgctctgtagactcc

SEQ ID NO: 63298 - DNA, 15 bp, Artificial Sequence
  dgRNA
  Atpif1
attaactgttaacta

SEQ ID NO: 63299 - DNA, 15 bp, Artificial Sequence
  dgRNA
  Atpif1
ctccctcctgattcg

SEQ ID NO: 63300 - DNA, 15 bp, Artificial Sequence
  dgRNA
  Atpif1
aacgcatcatgaccc

SEQ ID NO: 63301 - DNA, 15 bp, Artificial Sequence
  dgRNA
  Triqk
gtcctggaggctcgc

SEQ ID NO: 63302 - DNA, 15 bp, Artificial Sequence
  dgRNA
  Triqk
ccgcccctcctcgtc

SEQ ID NO: 63303 - DNA, 15 bp, Artificial Sequence
  dgRNA
  Triqk
gccctcctggagtag

SEQ ID NO: 63304 - DNA, 15 bp, Artificial Sequence
  dgRNA
  Triqk
tccctgcgagcctcc

SEQ ID NO: 63305 - DNA, 15 bp, Artificial Sequence
  dgRNA
  Ccdc36
gctcatagtacagtt

SEQ ID NO: 63306 - DNA, 15 bp, Artificial Sequence
  dgRNA
  Ccdc36
tgacacattaagtag

SEQ ID NO: 63307 - DNA, 15 bp, Artificial Sequence
  dgRNA
  Ccdc36
agtttttcaccaatt

SEQ ID NO: 63308 - DNA, 15 bp, Artificial Sequence
  dgRNA
  Ccdc36
tgttctgatccaaat

SEQ ID NO: 63309 - DNA, 15 bp, Artificial Sequence
  dgRNA
  Brsk1
gcctgcagcatccgc

SEQ ID NO: 63310 - DNA, 15 bp, Artificial Sequence
  dgRNA
  Brsk1
tcagaccccccctgc

SEQ ID NO: 63311 - DNA, 15 bp, Artificial Sequence
  dgRNA
  Brsk1
cagaccccccctgca

SEQ ID NO: 63312 - DNA, 15 bp, Artificial Sequence
  dgRNA
  Brsk1
agaccccccctgcag

SEQ ID NO: 63313 - DNA, 15 bp, Artificial Sequence
  dgRNA
  Frem1
cctcagtattaacac

SEQ ID NO: 63314 - DNA, 15 bp, Artificial Sequence
  dgRNA
  Frem1
ctttgttaataggtc

SEQ ID NO: 63315 - DNA, 15 bp, Artificial Sequence
  dgRNA
  Frem1
cctttgttaataggt

SEQ ID NO: 63316 - DNA, 15 bp, Artificial Sequence
  dgRNA
  Igbp1
ttgcaagtccacttc

SEQ ID NO: 63317 - DNA, 15 bp, Artificial Sequence
  dgRNA
  Igbp1
ccacttctggccacg

SEQ ID NO: 63318 - DNA, 15 bp, Artificial Sequence
  dgRNA
  Igbp1
cgactttaaaacaag

SEQ ID NO: 63319 - DNA, 15 bp, Artificial Sequence
  dgRNA
  Igbp1
ctggaaacggttgcc

SEQ ID NO: 63320 - DNA, 15 bp, Artificial Sequence
  dgRNA
  Igsf5
ctggatagggccact

SEQ ID NO: 63321 - DNA, 15 bp, Artificial Sequence
  dgRNA
  Igsf5
cccaggctataaacc

SEQ ID NO: 63322 - DNA, 15 bp, Artificial Sequence
  dgRNA
  Igsf5
ggacactcctcaccc

SEQ ID NO: 63323 - DNA, 15 bp, Artificial Sequence
  dgRNA
  Plac8
tcggagagctttgtc

SEQ ID NO: 63324 - DNA, 15 bp, Artificial Sequence
  dgRNA
  Plac8
ggcaggtagctaatc

SEQ ID NO: 63325 - DNA, 15 bp, Artificial Sequence
  dgRNA
  Plac8
gcaggtagctaatca

SEQ ID NO: 63326 - DNA, 15 bp, Artificial Sequence
  dgRNA
  Plac8
caggtagctaatcag

SEQ ID NO: 63327 - DNA, 15 bp, Artificial Sequence
  dgRNA
  Ctdspl2
aacctccgaaagcac

SEQ ID NO: 63328 - DNA, 15 bp, Artificial Sequence
  dgRNA
  Ctdspl2
gcaccgggaccaggc

SEQ ID NO: 63329 - DNA, 15 bp, Artificial Sequence
  dgRNA
  Ctdspl2
caccgggaccaggct

SEQ ID NO: 63330 - DNA, 15 bp, Artificial Sequence
  dgRNA
  Ctdspl2
gccatcgggagcgca

SEQ ID NO: 63331 - DNA, 15 bp, Artificial Sequence
  dgRNA
  Grm8
ttgcatatccgagtc

SEQ ID NO: 63332 - DNA, 15 bp, Artificial Sequence
  dgRNA
  Grm8
tgcatatccgagtct

SEQ ID NO: 63333 - DNA, 15 bp, Artificial Sequence
  dgRNA
  Grm8
gcatatccgagtctg

SEQ ID NO: 63334 - DNA, 15 bp, Artificial Sequence
  dgRNA
  Grm8
gcgggcggagagtcg

SEQ ID NO: 63335 - DNA, 15 bp, Artificial Sequence
  dgRNA
  Actc1
ccctagctccctata

SEQ ID NO: 63336 - DNA, 15 bp, Artificial Sequence
  dgRNA
  Actc1
cttccttacatggtc

SEQ ID NO: 63337 - DNA, 15 bp, Artificial Sequence
  dgRNA
  Actc1
ctcagcggtcctaga

SEQ ID NO: 63338 - DNA, 15 bp, Artificial Sequence
  dgRNA
  Actc1
tcctagatggtgcta

SEQ ID NO: 63339 - DNA, 15 bp, Artificial Sequence
  dgRNA
  Pdia4
gtggcagcccgtgat

SEQ ID NO: 63340 - DNA, 15 bp, Artificial Sequence
  dgRNA
  Pdia4
gcagcccgtgattgg

SEQ ID NO: 63341 - DNA, 15 bp, Artificial Sequence
  dgRNA
  Pdia4
cgtgattggtggtcg

SEQ ID NO: 63342 - DNA, 15 bp, Artificial Sequence
  dgRNA
  Pdia4
ggggcacctcacact

SEQ ID NO: 63343 - DNA, 15 bp, Artificial Sequence
  dgRNA
  Aff3
gcgggcccgggaagc

SEQ ID NO: 63344 - DNA, 15 bp, Artificial Sequence
  dgRNA
  Aff3
gaagcaggggccgcg

SEQ ID NO: 63345 - DNA, 15 bp, Artificial Sequence
  dgRNA
  Aff3
ggccgcgggggtgcc

SEQ ID NO: 63346 - DNA, 15 bp, Artificial Sequence
  dgRNA
  Aff3
cgggcactgagagcc

SEQ ID NO: 63347 - DNA, 15 bp, Artificial Sequence
  dgRNA
  Nfe2
gataaaccccttatc

SEQ ID NO: 63348 - DNA, 15 bp, Artificial Sequence
  dgRNA
  Nfe2
ggggaacctaaagta

SEQ ID NO: 63349 - DNA, 15 bp, Artificial Sequence
  dgRNA
  Nfe2
acctaaagtaaggat

SEQ ID NO: 63350 - DNA, 15 bp, Artificial Sequence
  dgRNA
  Nfe2
aagggttgctatcac

SEQ ID NO: 63351 - DNA, 15 bp, Artificial Sequence
  dgRNA
  Prps2
cggagcaactgtact

SEQ ID NO: 63352 - DNA, 15 bp, Artificial Sequence
  dgRNA
  Prps2
ggagcaactgtactt

SEQ ID NO: 63353 - DNA, 15 bp, Artificial Sequence
  dgRNA
  Prps2
gtacttgggtgcttc

SEQ ID NO: 63354 - DNA, 15 bp, Artificial Sequence
  dgRNA
  Prps2
gatgcccagcctgcg

SEQ ID NO: 63355 - DNA, 15 bp, Artificial Sequence
  dgRNA
  Olfr455
ggtaagatatccctt

SEQ ID NO: 63356 - DNA, 15 bp, Artificial Sequence
  dgRNA
  Olfr455
acctgtagtgaatcg

SEQ ID NO: 63357 - DNA, 15 bp, Artificial Sequence
  dgRNA
  Olfr455
tccacgattcactac

SEQ ID NO: 63358 - DNA, 15 bp, Artificial Sequence
  dgRNA
  Olfr455
gggtggctgcaaaaa

SEQ ID NO: 63359 - DNA, 15 bp, Artificial Sequence
  dgRNA
  Ero1lb
cctcattggccgccg

SEQ ID NO: 63360 - DNA, 15 bp, Artificial Sequence
  dgRNA
  Ero1lb
gcggagccccgcctc

SEQ ID NO: 63361 - DNA, 15 bp, Artificial Sequence
  dgRNA
  Ero1lb
cggagccccgcctca

SEQ ID NO: 63362 - DNA, 15 bp, Artificial Sequence
  dgRNA
  Ero1lb
agccccgcctcaggg

SEQ ID NO: 63363 - DNA, 15 bp, Artificial Sequence
  dgRNA
  Fam149a
acattctggaaccga

SEQ ID NO: 63364 - DNA, 15 bp, Artificial Sequence
  dgRNA
  Fam149a
cattctggaaccgat

SEQ ID NO: 63365 - DNA, 15 bp, Artificial Sequence
  dgRNA
  Fam149a
gatgggtccgcttgc

SEQ ID NO: 63366 - DNA, 15 bp, Artificial Sequence
  dgRNA
  Fam149a
atgggtccgcttgca

SEQ ID NO: 63367 - DNA, 15 bp, Artificial Sequence
  dgRNA
  Slc22a15
caccgctttgtgcga

SEQ ID NO: 63368 - DNA, 15 bp, Artificial Sequence
  dgRNA
  Slc22a15
accgctttgtgcgaa

SEQ ID NO: 63369 - DNA, 15 bp, Artificial Sequence
  dgRNA
  Slc22a15
ccgctttgtgcgaag

SEQ ID NO: 63370 - DNA, 15 bp, Artificial Sequence
  dgRNA
  Slc22a15
aaggggcgaaccccg

SEQ ID NO: 63371 - DNA, 15 bp, Artificial Sequence
  dgRNA
  Bpifb5
gagctggatccataa

SEQ ID NO: 63372 - DNA, 15 bp, Artificial Sequence
  dgRNA
  Bpifb5
atccataagggagtc

SEQ ID NO: 63373 - DNA, 15 bp, Artificial Sequence
  dgRNA
  Bpifb5
gcggggcacagagtg

SEQ ID NO: 63374 - DNA, 15 bp, Artificial Sequence
  dgRNA
  Bpifb5
cagagtggggtcacg

SEQ ID NO: 63375 - DNA, 15 bp, Artificial Sequence
  dgRNA
  Hps3
cgaccaaggcacaga

SEQ ID NO: 63376 - DNA, 15 bp, Artificial Sequence
  dgRNA
  Hps3
tgttaaacacgctga

SEQ ID NO: 63377 - DNA, 15 bp, Artificial Sequence
  dgRNA
  Hps3
acttcacttagcgcg

SEQ ID NO: 63378 - DNA, 15 bp, Artificial Sequence
  dgRNA
  Hps3
cgcgcggcctcttta

SEQ ID NO: 63379 - DNA, 15 bp, Artificial Sequence
  dgRNA
  Phc2
tcccctccgttgcca

SEQ ID NO: 63380 - DNA, 15 bp, Artificial Sequence
  dgRNA
  Phc2
tctccgagtgacgat

SEQ ID NO: 63381 - DNA, 15 bp, Artificial Sequence
  dgRNA
  Phc2
cgagtgacgattggc

SEQ ID NO: 63382 - DNA, 15 bp, Artificial Sequence
  dgRNA
  Phc2
gacgattggctggag

SEQ ID NO: 63383 - DNA, 15 bp, Artificial Sequence
  dgRNA
  Rnf7
cactttagcaagcgc

SEQ ID NO: 63384 - DNA, 15 bp, Artificial Sequence
  dgRNA
  Rnf7
actttagcaagcgct

SEQ ID NO: 63385 - DNA, 15 bp, Artificial Sequence
  dgRNA
  Rnf7
ctttagcaagcgctg

SEQ ID NO: 63386 - DNA, 15 bp, Artificial Sequence
  dgRNA
  Rnf7
ccctcgtgacgtcac

SEQ ID NO: 63387 - DNA, 15 bp, Artificial Sequence
  dgRNA
  Zbtb8os
gcgcgccccgcctgc

SEQ ID NO: 63388 - DNA, 15 bp, Artificial Sequence
  dgRNA
  Zbtb8os
gctgacaactccctc

SEQ ID NO: 63389 - DNA, 15 bp, Artificial Sequence
  dgRNA
  Zbtb8os
ggtagcgaaagaatt

SEQ ID NO: 63390 - DNA, 15 bp, Artificial Sequence
  dgRNA
  Zbtb8os
gagcgcgcgcgcctc

SEQ ID NO: 63391 - DNA, 15 bp, Artificial Sequence
  dgRNA
  Prdm8
accggcaagagttaa

SEQ ID NO: 63392 - DNA, 15 bp, Artificial Sequence
  dgRNA
  Prdm8
ccggcaagagttaaa

SEQ ID NO: 63393 - DNA, 15 bp, Artificial Sequence
  dgRNA
  Prdm8
gctgtcacgcgtcat

SEQ ID NO: 63394 - DNA, 15 bp, Artificial Sequence
  dgRNA
  Prdm8
ctgtcacgcgtcatt

SEQ ID NO: 63395 - DNA, 15 bp, Artificial Sequence
  dgRNA
  Irx5
gagaggcgggcgcta

SEQ ID NO: 63396 - DNA, 15 bp, Artificial Sequence
  dgRNA
  Irx5
aggcgggcgctaggg

SEQ ID NO: 63397 - DNA, 15 bp, Artificial Sequence
  dgRNA
  Irx5
ggcgggcgctaggga

SEQ ID NO: 63398 - DNA, 15 bp, Artificial Sequence
  dgRNA
  Irx5
gcgggcgctagggag

SEQ ID NO: 63399 - DNA, 15 bp, Artificial Sequence
  dgRNA
  Adipor1
gcgaggccgtggggt

SEQ ID NO: 63400 - DNA, 15 bp, Artificial Sequence
  dgRNA
  Adipor1
tagtttcccacccca

SEQ ID NO: 63401 - DNA, 15 bp, Artificial Sequence
  dgRNA
  Spata31d1d
gccattgtgagggcg

SEQ ID NO: 63402 - DNA, 15 bp, Artificial Sequence
  dgRNA
  Chrna1
cgatcatgttaagca

SEQ ID NO: 63403 - DNA, 15 bp, Artificial Sequence
  dgRNA
  Chrna1
agcaaggcacgtctg

SEQ ID NO: 63404 - DNA, 15 bp, Artificial Sequence
  dgRNA
  Chrna1
gtcatgcgggcacac

SEQ ID NO: 63405 - DNA, 15 bp, Artificial Sequence
  dgRNA
  Chrna1
caagctccctaagcc

SEQ ID NO: 63406 - DNA, 15 bp, Artificial Sequence
  dgRNA
  Tusc2
ttacctccgcctttc

SEQ ID NO: 63407 - DNA, 15 bp, Artificial Sequence
  dgRNA
  Tusc2
ctccgcctttctgga

SEQ ID NO: 63408 - DNA, 15 bp, Artificial Sequence
  dgRNA
  Tusc2
tccgcctttctggaa

SEQ ID NO: 63409 - DNA, 15 bp, Artificial Sequence
  dgRNA
  Tusc2
ggacccataggcttc

SEQ ID NO: 63410 - DNA, 15 bp, Artificial Sequence
  dgRNA
  Cdkn2c
gccagaatccttctt

SEQ ID NO: 63411 - DNA, 15 bp, Artificial Sequence
  dgRNA
  Cdkn2c
gttgcggagacttaa

SEQ ID NO: 63412 - DNA, 15 bp, Artificial Sequence
  dgRNA
  Cdkn2c
atggacgtgagatgt

SEQ ID NO: 63413 - DNA, 15 bp, Artificial Sequence
  dgRNA
  Cdkn2c
ccctaagaaggattc

SEQ ID NO: 63414 - DNA, 15 bp, Artificial Sequence
  dgRNA
  Olfr1283
attggtagtatgtat

SEQ ID NO: 63415 - DNA, 15 bp, Artificial Sequence
  dgRNA
  Olfr1283
caataacttaacgtt

SEQ ID NO: 63416 - DNA, 15 bp, Artificial Sequence
  dgRNA
  Slc25a24
cctagtcgccagcgc

SEQ ID NO: 63417 - DNA, 15 bp, Artificial Sequence
  dgRNA
  Slc25a24
tcgccagcgcaggcc

SEQ ID NO: 63418 - DNA, 15 bp, Artificial Sequence
  dgRNA
  Slc25a24
cgccagcgcaggcct

SEQ ID NO: 63419 - DNA, 15 bp, Artificial Sequence
  dgRNA
  Slc25a24
cgaccacaccctgtg

SEQ ID NO: 63420 - DNA, 15 bp, Artificial Sequence
  dgRNA
  Olfr1340
taagtacctagagcc

SEQ ID NO: 63421 - DNA, 15 bp, Artificial Sequence
  dgRNA
  Olfr1340
ctggccaggctaatt

SEQ ID NO: 63422 - DNA, 15 bp, Artificial Sequence
  dgRNA
  Olfr1340
ggatagattacttcc

SEQ ID NO: 63423 - DNA, 15 bp, Artificial Sequence
  dgRNA
  Olfr1340
gagttccccatttgt

SEQ ID NO: 63424 - DNA, 15 bp, Artificial Sequence
  dgRNA
  Haus2
tccgatagctgctgc

SEQ ID NO: 63425 - DNA, 15 bp, Artificial Sequence
  dgRNA
  Haus2
agctgctgccggaac

SEQ ID NO: 63426 - DNA, 15 bp, Artificial Sequence
  dgRNA
  Haus2
gctgctgccggaaca

SEQ ID NO: 63427 - DNA, 15 bp, Artificial Sequence
  dgRNA
  Haus2
aaagaagactccgcc

SEQ ID NO: 63428 - DNA, 15 bp, Artificial Sequence
  dgRNA
  Ube4a
gcgcatgcgcctcct

SEQ ID NO: 63429 - DNA, 15 bp, Artificial Sequence
  dgRNA
  Ube4a
acaccgccctacttc

SEQ ID NO: 63430 - DNA, 15 bp, Artificial Sequence
  dgRNA
  Ube4a
gccctacttccggcg

SEQ ID NO: 63431 - DNA, 15 bp, Artificial Sequence
  dgRNA
  Ube4a
ccctacttccggcgc

SEQ ID NO: 63432 - DNA, 15 bp, Artificial Sequence
  dgRNA
  Dbx2
gggtttggctattgg

SEQ ID NO: 63433 - DNA, 15 bp, Artificial Sequence
  dgRNA
  Ptprm
ccgcaggcgccgcgc

SEQ ID NO: 63434 - DNA, 15 bp, Artificial Sequence
  dgRNA
  Ptprm
ccgcgcaggccgagc

SEQ ID NO: 63435 - DNA, 15 bp, Artificial Sequence
  dgRNA
  Ptprm
ggccgagctggcccg

SEQ ID NO: 63436 - DNA, 15 bp, Artificial Sequence
  dgRNA
  Ptprm
ctcgcgccctctagc

SEQ ID NO: 63437 - DNA, 15 bp, Artificial Sequence
  dgRNA
  Zfp488
ccgaagccagagtcg

SEQ ID NO: 63438 - DNA, 15 bp, Artificial Sequence
  dgRNA
  Zfp488
aagccagagtcgagg

SEQ ID NO: 63439 - DNA, 15 bp, Artificial Sequence
  dgRNA
  Zfp488
agccagagtcgagga

SEQ ID NO: 63440 - DNA, 15 bp, Artificial Sequence
  dgRNA
  Zfp488
agttgctacagtcta

SEQ ID NO: 63441 - DNA, 15 bp, Artificial Sequence
  dgRNA
  Ctnna3
aacggttccttgttt

SEQ ID NO: 63442 - DNA, 15 bp, Artificial Sequence
  dgRNA
  Ctnna3
gcttccgaagaagta

SEQ ID NO: 63443 - DNA, 15 bp, Artificial Sequence
  dgRNA
  Ctnna3
tccgaagaagtatgg

SEQ ID NO: 63444 - DNA, 15 bp, Artificial Sequence
  dgRNA
  Ctnna3
gtatggaggtctcta

SEQ ID NO: 63445 - DNA, 15 bp, Artificial Sequence
  dgRNA
  Rasgef1c
gcttggacaaggcga

SEQ ID NO: 63446 - DNA, 15 bp, Artificial Sequence
  dgRNA
  Rasgef1c
caaggcgacggcatg

SEQ ID NO: 63447 - DNA, 15 bp, Artificial Sequence
  dgRNA
  Rasgef1c
cgacggcatgcggag

SEQ ID NO: 63448 - DNA, 15 bp, Artificial Sequence
  dgRNA
  Rasgef1c
gcatgcggagtggac

SEQ ID NO: 63449 - DNA, 15 bp, Artificial Sequence
  dgRNA
  Rpl29
atctgtgacgctaag

SEQ ID NO: 63450 - DNA, 15 bp, Artificial Sequence
  dgRNA
  Rpl29
tctgtgacgctaaga

SEQ ID NO: 63451 - DNA, 15 bp, Artificial Sequence
  dgRNA
  Rpl29
gacgctaagagggcg

SEQ ID NO: 63452 - DNA, 15 bp, Artificial Sequence
  dgRNA
  Rpl29
taagagggcgtggcc

SEQ ID NO: 63453 - DNA, 15 bp, Artificial Sequence
  dgRNA
  4930474N05Rik
ggttgaagtggatct

SEQ ID NO: 63454 - DNA, 15 bp, Artificial Sequence
  dgRNA
  4930474N05Rik
gctcacagggttgtt

SEQ ID NO: 63455 - DNA, 15 bp, Artificial Sequence
  dgRNA
  Fam167a
taagacgggacggga

SEQ ID NO: 63456 - DNA, 15 bp, Artificial Sequence
  dgRNA
  Fam167a
aagacgggacgggac

SEQ ID NO: 63457 - DNA, 15 bp, Artificial Sequence
  dgRNA
  Fam167a
gggtttgatttcgcc

SEQ ID NO: 63458 - DNA, 15 bp, Artificial Sequence
  dgRNA
  Fam167a
gcttggccttgcacg

SEQ ID NO: 63459 - DNA, 15 bp, Artificial Sequence
  dgRNA
  Vipr1
ccagcgtccccgcat

SEQ ID NO: 63460 - DNA, 15 bp, Artificial Sequence
  dgRNA
  Vipr1
catcggagagccgag

SEQ ID NO: 63461 - DNA, 15 bp, Artificial Sequence
  dgRNA
  Vipr1
gacgcgcacctctag

SEQ ID NO: 63462 - DNA, 15 bp, Artificial Sequence
  dgRNA
  Vipr1
acgcgcacctctagc

SEQ ID NO: 63463 - DNA, 15 bp, Artificial Sequence
  dgRNA
  Dab2ip
cattggctagcacaa

SEQ ID NO: 63464 - DNA, 15 bp, Artificial Sequence
  dgRNA
  Dab2ip
ctgggccaacgttcc

SEQ ID NO: 63465 - DNA, 15 bp, Artificial Sequence
  dgRNA
  Dab2ip
gtgctagccaatgcc

SEQ ID NO: 63466 - DNA, 15 bp, Artificial Sequence
  dgRNA
  Dab2ip
tgtgctagccaatgc

SEQ ID NO: 63467 - DNA, 15 bp, Artificial Sequence
  dgRNA
  Ndnl2
ctgctgccagcgccg

SEQ ID NO: 63468 - DNA, 15 bp, Artificial Sequence
  dgRNA
  Ndnl2
tatcgctccgcctcc

SEQ ID NO: 63469 - DNA, 15 bp, Artificial Sequence
  dgRNA
  Ndnl2
ccggacgcagcgcgc

SEQ ID NO: 63470 - DNA, 15 bp, Artificial Sequence
  dgRNA
  Ndnl2
ggagggcctcggcgc

SEQ ID NO: 63471 - DNA, 15 bp, Artificial Sequence
  dgRNA
  Tdrkh
cagccacgtcgctca

SEQ ID NO: 63472 - DNA, 15 bp, Artificial Sequence
  dgRNA
  Tdrkh
acggcagtccgcaga

SEQ ID NO: 63473 - DNA, 15 bp, Artificial Sequence
  dgRNA
  Tdrkh
agtccgcagaaggat

SEQ ID NO: 63474 - DNA, 15 bp, Artificial Sequence
  dgRNA
  Tdrkh
aaggattggctgcgg

SEQ ID NO: 63475 - DNA, 15 bp, Artificial Sequence
  dgRNA
  Cdk17
tttctccgccgccgc

SEQ ID NO: 63476 - DNA, 15 bp, Artificial Sequence
  dgRNA
  Cdk17
tccgccgccgctggt

SEQ ID NO: 63477 - DNA, 15 bp, Artificial Sequence
  dgRNA
  Cdk17
cgctctcgctcgctc

SEQ ID NO: 63478 - DNA, 15 bp, Artificial Sequence
  dgRNA
  Cdk17
gctctcgctcgctcc

SEQ ID NO: 63479 - DNA, 15 bp, Artificial Sequence
  dgRNA
  Boc
agaaagtaggcgtta

SEQ ID NO: 63480 - DNA, 15 bp, Artificial Sequence
  dgRNA
  Boc
gaaagtaggcgttaa

SEQ ID NO: 63481 - DNA, 15 bp, Artificial Sequence
  dgRNA
  Boc
gttctaaaattgggg

SEQ ID NO: 63482 - DNA, 15 bp, Artificial Sequence
  dgRNA
  Boc
cctcccctcttcgag

SEQ ID NO: 63483 - DNA, 15 bp, Artificial Sequence
  dgRNA
  Cln3
gttattcttgtactg

SEQ ID NO: 63484 - DNA, 15 bp, Artificial Sequence
  dgRNA
  Cln3
ttctagagactcgtt

SEQ ID NO: 63485 - DNA, 15 bp, Artificial Sequence
  dgRNA
  Cln3
tctagagactcgttt

SEQ ID NO: 63486 - DNA, 15 bp, Artificial Sequence
  dgRNA
  Cln3
gagactcgtttgggt

SEQ ID NO: 63487 - DNA, 15 bp, Artificial Sequence
  dgRNA
  Cpsf2
gtggcgtcggcaaac

SEQ ID NO: 63488 - DNA, 15 bp, Artificial Sequence
  dgRNA
  Cpsf2
gttttgaataagacg

SEQ ID NO: 63489 - DNA, 15 bp, Artificial Sequence
  dgRNA
  Cpsf2
ataagacgtggatcc

SEQ ID NO: 63490 - DNA, 15 bp, Artificial Sequence
  dgRNA
  Cpsf2
acagatggtgtcgcc

SEQ ID NO: 63491 - DNA, 15 bp, Artificial Sequence
  dgRNA
  Scn4b
tggtgggcggcgtgc

SEQ ID NO: 63492 - DNA, 15 bp, Artificial Sequence
  dgRNA
  Scn4b
cgcagagcgaatgag

SEQ ID NO: 63493 - DNA, 15 bp, Artificial Sequence
  dgRNA
  Scn4b
agcgaatgagcggcg

SEQ ID NO: 63494 - DNA, 15 bp, Artificial Sequence
  dgRNA
  Scn4b
aatgagcggcgcggc

SEQ ID NO: 63495 - DNA, 15 bp, Artificial Sequence
  dgRNA
  Pnpla3
tccaagcctaggatt

SEQ ID NO: 63496 - DNA, 15 bp, Artificial Sequence
  dgRNA
  Pnpla3
ttgggaaagcccacg

SEQ ID NO: 63497 - DNA, 15 bp, Artificial Sequence
  dgRNA
  Pnpla3
tgggaaagcccacgc

SEQ ID NO: 63498 - DNA, 15 bp, Artificial Sequence
  dgRNA
  Pnpla3
gaaagcccacgcggg

SEQ ID NO: 63499 - DNA, 15 bp, Artificial Sequence
  dgRNA
  Srfbp1
caaagcgcactagct

SEQ ID NO: 63500 - DNA, 15 bp, Artificial Sequence
  dgRNA
  Srfbp1
ggaaacgctcaattc

SEQ ID NO: 63501 - DNA, 15 bp, Artificial Sequence
  dgRNA
  Srfbp1
tagtcgtacacgcgc

SEQ ID NO: 63502 - DNA, 15 bp, Artificial Sequence
  dgRNA
  Srfbp1
caccgttcccacttg

SEQ ID NO: 63503 - DNA, 15 bp, Artificial Sequence
  dgRNA
  Olfr403
ttgccatggaccaac

SEQ ID NO: 63504 - DNA, 15 bp, Artificial Sequence
  dgRNA
  Olfr403
attccccaaattata

SEQ ID NO: 63505 - DNA, 15 bp, Artificial Sequence
  dgRNA
  Olfr403
ctaatttcatagatc

SEQ ID NO: 63506 - DNA, 15 bp, Artificial Sequence
  dgRNA
  Olfr403
tcataattgcactaa

SEQ ID NO: 63507 - DNA, 15 bp, Artificial Sequence
  dgRNA
  Sfrp1
taaggggtgttgacc

SEQ ID NO: 63508 - DNA, 15 bp, Artificial Sequence
  dgRNA
  Sfrp1
aaggggtgttgacct

SEQ ID NO: 63509 - DNA, 15 bp, Artificial Sequence
  dgRNA
  Sfrp1
gtaaaccgatccttc

SEQ ID NO: 63510 - DNA, 15 bp, Artificial Sequence
  dgRNA
  Sfrp1
accgatccttctggc

SEQ ID NO: 63511 - DNA, 15 bp, Artificial Sequence
  dgRNA
  Spag7
atttaaggcgctgcg

SEQ ID NO: 63512 - DNA, 15 bp, Artificial Sequence
  dgRNA
  Spag7
aaggcgctgcgcggc

SEQ ID NO: 63513 - DNA, 15 bp, Artificial Sequence
  dgRNA
  Spag7
aggcgctgcgcggcc

SEQ ID NO: 63514 - DNA, 15 bp, Artificial Sequence
  dgRNA
  Spag7
tctgattccctggcg

SEQ ID NO: 63515 - DNA, 15 bp, Artificial Sequence
  dgRNA
  9-Sep
tccgctcctattctt

SEQ ID NO: 63516 - DNA, 15 bp, Artificial Sequence
  dgRNA
  9-Sep
attctttggaccccc

SEQ ID NO: 63517 - DNA, 15 bp, Artificial Sequence
  dgRNA
  9-Sep
cccccacggaggctc

SEQ ID NO: 63518 - DNA, 15 bp, Artificial Sequence
  dgRNA
  9-Sep
gagcggatacttctg

SEQ ID NO: 63519 - DNA, 15 bp, Artificial Sequence
  dgRNA
  Vmn2r26
tactccagcgaactg

SEQ ID NO: 63520 - DNA, 15 bp, Artificial Sequence
  dgRNA
  Vmn2r26
actccagcgaactga

SEQ ID NO: 63521 - DNA, 15 bp, Artificial Sequence
  dgRNA
  Vmn2r26
actccctcagttcgc

SEQ ID NO: 63522 - DNA, 15 bp, Artificial Sequence
  dgRNA
  Pnp2
gcctccttttctagc

SEQ ID NO: 63523 - DNA, 15 bp, Artificial Sequence
  dgRNA
  Pnp2
tcatgactgtgtgcg

SEQ ID NO: 63524 - DNA, 15 bp, Artificial Sequence
  dgRNA
  Pnp2
catgactgtgtgcgg

SEQ ID NO: 63525 - DNA, 15 bp, Artificial Sequence
  dgRNA
  Pnp2
ggggggatcacctgc

SEQ ID NO: 63526 - DNA, 15 bp, Artificial Sequence
  dgRNA
  Sptssa
cccagaccgtttccc

SEQ ID NO: 63527 - DNA, 15 bp, Artificial Sequence
  dgRNA
  Sptssa
ccagaccgtttccca

SEQ ID NO: 63528 - DNA, 15 bp, Artificial Sequence
  dgRNA
  Sptssa
accgtttcccagggc

SEQ ID NO: 63529 - DNA, 15 bp, Artificial Sequence
  dgRNA
  Sptssa
tggggagctcgctcc

SEQ ID NO: 63530 - DNA, 15 bp, Artificial Sequence
  dgRNA
  Sall2
cattcatgtcggatc

SEQ ID NO: 63531 - DNA, 15 bp, Artificial Sequence
  dgRNA
  Sall2
atgaatgaacgaacg

SEQ ID NO: 63532 - DNA, 15 bp, Artificial Sequence
  dgRNA
  Cnot10
cactagtgtacttcc

SEQ ID NO: 63533 - DNA, 15 bp, Artificial Sequence
  dgRNA
  Cnot10
agaaggacgcgcttc

SEQ ID NO: 63534 - DNA, 15 bp, Artificial Sequence
  dgRNA
  Cnot10
gaaggacgcgcttcc

SEQ ID NO: 63535 - DNA, 15 bp, Artificial Sequence
  dgRNA
  Cnot10
aaggacgcgcttccg

SEQ ID NO: 63536 - DNA, 15 bp, Artificial Sequence
  dgRNA
  P2ry2
ggaccctgcgccact

SEQ ID NO: 63537 - DNA, 15 bp, Artificial Sequence
  dgRNA
  P2ry2
ctgcgccactcggca

SEQ ID NO: 63538 - DNA, 15 bp, Artificial Sequence
  dgRNA
  P2ry2
tgcgccactcggcat

SEQ ID NO: 63539 - DNA, 15 bp, Artificial Sequence
  dgRNA
  P2ry2
actcggcatgggact

SEQ ID NO: 63540 - DNA, 15 bp, Artificial Sequence
  dgRNA
  Fam58b
cctatcttttaatat

SEQ ID NO: 63541 - DNA, 15 bp, Artificial Sequence
  dgRNA
  Fam58b
atcttttaatatagg

SEQ ID NO: 63542 - DNA, 15 bp, Artificial Sequence
  dgRNA
  Fam58b
gaggaaaagccgagc

SEQ ID NO: 63543 - DNA, 15 bp, Artificial Sequence
  dgRNA
  Fam58b
aaagccgagcagggt

SEQ ID NO: 63544 - DNA, 15 bp, Artificial Sequence
  dgRNA
  Lox
aaggcttatgcttaa

SEQ ID NO: 63545 - DNA, 15 bp, Artificial Sequence
  dgRNA
  Lox
gggaggttgtgacta

SEQ ID NO: 63546 - DNA, 15 bp, Artificial Sequence
  dgRNA
  Rbm10
agagcgggcctctta

SEQ ID NO: 63547 - DNA, 15 bp, Artificial Sequence
  dgRNA
  Rbm10
gagcgggcctcttag

SEQ ID NO: 63548 - DNA, 15 bp, Artificial Sequence
  dgRNA
  Rbm10
ttggctacccctaag

SEQ ID NO: 63549 - DNA, 15 bp, Artificial Sequence
  dgRNA
  Rbm10
ggagcgcgctctggc

SEQ ID NO: 63550 - DNA, 15 bp, Artificial Sequence
  dgRNA
  Mcoln2
gtcaggacggccagg

SEQ ID NO: 63551 - DNA, 15 bp, Artificial Sequence
  dgRNA
  Mcoln2
ggacggccagggggg

SEQ ID NO: 63552 - DNA, 15 bp, Artificial Sequence
  dgRNA
  Mcoln2
gacggccaggggggc

SEQ ID NO: 63553 - DNA, 15 bp, Artificial Sequence
  dgRNA
  Mcoln2
acggccaggggggcg

SEQ ID NO: 63554 - DNA, 15 bp, Artificial Sequence
  dgRNA
  Kcnb1
gcctctcccgcctgg

SEQ ID NO: 63555 - DNA, 15 bp, Artificial Sequence
  dgRNA
  Kcnb1
ccttcgtcctggggt

SEQ ID NO: 63556 - DNA, 15 bp, Artificial Sequence
  dgRNA
  Kcnb1
tgacttcagcaccgg

SEQ ID NO: 63557 - DNA, 15 bp, Artificial Sequence
  dgRNA
  Kcnb1
gacttcagcaccggc

SEQ ID NO: 63558 - DNA, 15 bp, Artificial Sequence
  dgRNA
  Maml2
actcttgcacttccc

SEQ ID NO: 63559 - DNA, 15 bp, Artificial Sequence
  dgRNA
  Maml2
agttctcagcgcagt

SEQ ID NO: 63560 - DNA, 15 bp, Artificial Sequence
  dgRNA
  Maml2
gttctcagcgcagtt

SEQ ID NO: 63561 - DNA, 15 bp, Artificial Sequence
  dgRNA
  Maml2
ttctcagcgcagttg

SEQ ID NO: 63562 - DNA, 15 bp, Artificial Sequence
  dgRNA
  Lmo3
agcggcacattacag

SEQ ID NO: 63563 - DNA, 15 bp, Artificial Sequence
  dgRNA
  Lmo3
agtggtccactacca

SEQ ID NO: 63564 - DNA, 15 bp, Artificial Sequence
  dgRNA
  Lmo3
gtccactaccacggc

SEQ ID NO: 63565 - DNA, 15 bp, Artificial Sequence
  dgRNA
  Lmo3
gggtccagttggttt

SEQ ID NO: 63566 - DNA, 15 bp, Artificial Sequence
  dgRNA
  Thap7
gcgcgtacgttgttc

SEQ ID NO: 63567 - DNA, 15 bp, Artificial Sequence
  dgRNA
  Thap7
cgcgtacgttgttca

SEQ ID NO: 63568 - DNA, 15 bp, Artificial Sequence
  dgRNA
  Thap7
acgctcaaacaaaac

SEQ ID NO: 63569 - DNA, 15 bp, Artificial Sequence
  dgRNA
  Thap7
cgctcaaacaaaaca

SEQ ID NO: 63570 - DNA, 15 bp, Artificial Sequence
  dgRNA
  Rasgef1a
agccacatcatcttt

SEQ ID NO: 63571 - DNA, 15 bp, Artificial Sequence
  dgRNA
  Rasgef1a
gcccgccctctcccg

SEQ ID NO: 63572 - DNA, 15 bp, Artificial Sequence
  dgRNA
  Rasgef1a
ccgcgctcgtgctcc

SEQ ID NO: 63573 - DNA, 15 bp, Artificial Sequence
  dgRNA
  Rasgef1a
cgcgctcgtgctccc

SEQ ID NO: 63574 - DNA, 15 bp, Artificial Sequence
  dgRNA
  Ahsg
tttacgcaattcctt

SEQ ID NO: 63575 - DNA, 15 bp, Artificial Sequence
  dgRNA
  Ahsg
acgcaattccttcgg

SEQ ID NO: 63576 - DNA, 15 bp, Artificial Sequence
  dgRNA
  Ahsg
cgcaattccttcggc

SEQ ID NO: 63577 - DNA, 15 bp, Artificial Sequence
  dgRNA
  Ahsg
ggacgatttctgttc

SEQ ID NO: 63578 - DNA, 15 bp, Artificial Sequence
  dgRNA
  Ang
gcaggcagacccaat

SEQ ID NO: 63579 - DNA, 15 bp, Artificial Sequence
  dgRNA
  Ang
caggcagacccaatg

SEQ ID NO: 63580 - DNA, 15 bp, Artificial Sequence
  dgRNA
  Ang
gcagacccaatgggg

SEQ ID NO: 63581 - DNA, 15 bp, Artificial Sequence
  dgRNA
  Ang
cggtcccagccaccg

SEQ ID NO: 63582 - DNA, 15 bp, Artificial Sequence
  dgRNA
  Fxyd1
atggggtggcctgta

SEQ ID NO: 63583 - DNA, 15 bp, Artificial Sequence
  dgRNA
  Fxyd1
ccagcagtgttatac

SEQ ID NO: 63584 - DNA, 15 bp, Artificial Sequence
  dgRNA
  Fxyd1
gaccccctgagtctt

SEQ ID NO: 63585 - DNA, 15 bp, Artificial Sequence
  dgRNA
  Fxyd1
accccctgagtcttt

SEQ ID NO: 63586 - DNA, 15 bp, Artificial Sequence
  dgRNA
  Galnt10
aggatggaggcgaat

SEQ ID NO: 63587 - DNA, 15 bp, Artificial Sequence
  dgRNA
  Galnt10
caaccgtgcatctgt

SEQ ID NO: 63588 - DNA, 15 bp, Artificial Sequence
  dgRNA
  Galnt10
ccgtgcatctgttgg

SEQ ID NO: 63589 - DNA, 15 bp, Artificial Sequence
  dgRNA
  Galnt10
gcatctgttggcgga

SEQ ID NO: 63590 - DNA, 15 bp, Artificial Sequence
  dgRNA
  Klhl1
tacagtaatgtagag

SEQ ID NO: 63591 - DNA, 15 bp, Artificial Sequence
  dgRNA
  Klhl1
tgacagacttacgca

SEQ ID NO: 63592 - DNA, 15 bp, Artificial Sequence
  dgRNA
  Klhl1
gacagacttacgcaa

SEQ ID NO: 63593 - DNA, 15 bp, Artificial Sequence
  dgRNA
  Klhl1
acagacttacgcaag

SEQ ID NO: 63594 - DNA, 15 bp, Artificial Sequence
  dgRNA
  Lect1
agcagcgtcctgctc

SEQ ID NO: 63595 - DNA, 15 bp, Artificial Sequence
  dgRNA
  Gpihbp1
cctctctatccccgg

SEQ ID NO: 63596 - DNA, 15 bp, Artificial Sequence
  dgRNA
  Gpihbp1
ccccggaggttctgg

SEQ ID NO: 63597 - DNA, 15 bp, Artificial Sequence
  dgRNA
  Gpihbp1
cccggaggttctgga

SEQ ID NO: 63598 - DNA, 15 bp, Artificial Sequence
  dgRNA
  Gpihbp1
taagattagagctgg

SEQ ID NO: 63599 - DNA, 15 bp, Artificial Sequence
  dgRNA
  Rnf17
gctacctatggtcgc

SEQ ID NO: 63600 - DNA, 15 bp, Artificial Sequence
  dgRNA
  Rnf17
ccggagtcctgtgat

SEQ ID NO: 63601 - DNA, 15 bp, Artificial Sequence
  dgRNA
  Rnf17
ttggttcttgacgcg

SEQ ID NO: 63602 - DNA, 15 bp, Artificial Sequence
  dgRNA
  Rnf17
tggttcttgacgcga

SEQ ID NO: 63603 - DNA, 15 bp, Artificial Sequence
  dgRNA
  Polm
agtggagggttatcc

SEQ ID NO: 63604 - DNA, 15 bp, Artificial Sequence
  dgRNA
  Polm
acttctcatatggcc

SEQ ID NO: 63605 - DNA, 15 bp, Artificial Sequence
  dgRNA
  Polm
ctgagaccccgccct

SEQ ID NO: 63606 - DNA, 15 bp, Artificial Sequence
  dgRNA
  Polm
tgagaccccgccctc

SEQ ID NO: 63607 - DNA, 15 bp, Artificial Sequence
  dgRNA
  Dhrs1
gataaccatcgcggc

SEQ ID NO: 63608 - DNA, 15 bp, Artificial Sequence
  dgRNA
  Dhrs1
ataaccatcgcggcc

SEQ ID NO: 63609 - DNA, 15 bp, Artificial Sequence
  dgRNA
  Dhrs1
accatcgcggccggg

SEQ ID NO: 63610 - DNA, 15 bp, Artificial Sequence
  dgRNA
  Dhrs1
ccatcgcggccggga

SEQ ID NO: 63611 - DNA, 15 bp, Artificial Sequence
  dgRNA
  Strbp
atgagtcatgtgtat

SEQ ID NO: 63612 - DNA, 15 bp, Artificial Sequence
  dgRNA
  Strbp
ttacgtgggtgctca

SEQ ID NO: 63613 - DNA, 15 bp, Artificial Sequence
  dgRNA
  Strbp
tgtgccatgcttacg

SEQ ID NO: 63614 - DNA, 15 bp, Artificial Sequence
  dgRNA
  Scaf1
tttccccgcgcacgc

SEQ ID NO: 63615 - DNA, 15 bp, Artificial Sequence
  dgRNA
  Scaf1
cacgcaggacactga

SEQ ID NO: 63616 - DNA, 15 bp, Artificial Sequence
  dgRNA
  Scaf1
acgcaggacactgag

SEQ ID NO: 63617 - DNA, 15 bp, Artificial Sequence
  dgRNA
  Scaf1
ctgtcccccgcgtga

SEQ ID NO: 63618 - DNA, 15 bp, Artificial Sequence
  dgRNA
  Fam13c
tcctagctgcctacc

SEQ ID NO: 63619 - DNA, 15 bp, Artificial Sequence
  dgRNA
  Fam13c
cctagctgcctacca

SEQ ID NO: 63620 - DNA, 15 bp, Artificial Sequence
  dgRNA
  Fam13c
cctaccagggttgcg

SEQ ID NO: 63621 - DNA, 15 bp, Artificial Sequence
  dgRNA
  Fam13c
gcgcggagcagctcc

SEQ ID NO: 63622 - DNA, 15 bp, Artificial Sequence
  dgRNA
  Coasy
ctcctcctggcaaac

SEQ ID NO: 63623 - DNA, 15 bp, Artificial Sequence
  dgRNA
  Coasy
tgggaatccgcgaaa

SEQ ID NO: 63624 - DNA, 15 bp, Artificial Sequence
  dgRNA
  Coasy
gggaatccgcgaaaa

SEQ ID NO: 63625 - DNA, 15 bp, Artificial Sequence
  dgRNA
  Coasy
ctcgcttcgtctaag

SEQ ID NO: 63626 - DNA, 15 bp, Artificial Sequence
  dgRNA
  Aasdh
ttcacgcagacgcac

SEQ ID NO: 63627 - DNA, 15 bp, Artificial Sequence
  dgRNA
  Aasdh
aagcgtcaccttcag

SEQ ID NO: 63628 - DNA, 15 bp, Artificial Sequence
  dgRNA
  Aasdh
gtcaccttcagcggc

SEQ ID NO: 63629 - DNA, 15 bp, Artificial Sequence
  dgRNA
  Aasdh
tcaccttcagcggca

SEQ ID NO: 63630 - DNA, 15 bp, Artificial Sequence
  dgRNA
  Dapk1
acggagcacgtcgcc

SEQ ID NO: 63631 - DNA, 15 bp, Artificial Sequence
  dgRNA
  Dapk1
gtcgcctggcccaca

SEQ ID NO: 63632 - DNA, 15 bp, Artificial Sequence
  dgRNA
  Dapk1
gcccacacggatcct

SEQ ID NO: 63633 - DNA, 15 bp, Artificial Sequence
  dgRNA
  Dapk1
cccacacggatcctt

SEQ ID NO: 63634 - DNA, 15 bp, Artificial Sequence
  dgRNA
  Jdp2
gctgtgcacagacgg

SEQ ID NO: 63635 - DNA, 15 bp, Artificial Sequence
  dgRNA
  Jdp2
tgccggggactgcgg

SEQ ID NO: 63636 - DNA, 15 bp, Artificial Sequence
  dgRNA
  Jdp2
actgcgggggactca

SEQ ID NO: 63637 - DNA, 15 bp, Artificial Sequence
  dgRNA
  Jdp2
ctgcgggggactcaa

SEQ ID NO: 63638 - DNA, 15 bp, Artificial Sequence
  dgRNA
  Zfp521
cgagccgtcggcgcg

SEQ ID NO: 63639 - DNA, 15 bp, Artificial Sequence
  dgRNA
  Zfp521
gagccgtcggcgcgc

SEQ ID NO: 63640 - DNA, 15 bp, Artificial Sequence
  dgRNA
  Zfp521
ccgtcggcgcgcggg

SEQ ID NO: 63641 - DNA, 15 bp, Artificial Sequence
  dgRNA
  Zfp521
ggcaggcgggcgcga

SEQ ID NO: 63642 - DNA, 15 bp, Artificial Sequence
  dgRNA
  Efemp2
gcggggggcgcttcc

SEQ ID NO: 63643 - DNA, 15 bp, Artificial Sequence
  dgRNA
  Efemp2
cggggggcgcttcct

SEQ ID NO: 63644 - DNA, 15 bp, Artificial Sequence
  dgRNA
  Efemp2
ggggggcgcttcctg

SEQ ID NO: 63645 - DNA, 15 bp, Artificial Sequence
  dgRNA
  Efemp2
gtccagtgagctgcg

SEQ ID NO: 63646 - DNA, 15 bp, Artificial Sequence
  dgRNA
  Gm44444
tatgaggataagggc

SEQ ID NO: 63647 - DNA, 15 bp, Artificial Sequence
  dgRNA
  Gm44444
attgtatgaggataa

SEQ ID NO: 63648 - DNA, 15 bp, Artificial Sequence
  dgRNA
  Rbm47
tattacccttgaaat

SEQ ID NO: 63649 - DNA, 15 bp, Artificial Sequence
  dgRNA
  Rbm47
gggcactcctgacac

SEQ ID NO: 63650 - DNA, 15 bp, Artificial Sequence
  dgRNA
  Rbm47
actcctgacacaggt

SEQ ID NO: 63651 - DNA, 15 bp, Artificial Sequence
  dgRNA
  Rbm47
caagcttagttagcc

SEQ ID NO: 63652 - DNA, 15 bp, Artificial Sequence
  dgRNA
  Xpnpep1
taacctaatgctaac

SEQ ID NO: 63653 - DNA, 15 bp, Artificial Sequence
  dgRNA
  Xpnpep1
aacctaatgctaacc

SEQ ID NO: 63654 - DNA, 15 bp, Artificial Sequence
  dgRNA
  Xpnpep1
gacagctgaacccgt

SEQ ID NO: 63655 - DNA, 15 bp, Artificial Sequence
  dgRNA
  Xpnpep1
ggatacaagcgtact

SEQ ID NO: 63656 - DNA, 15 bp, Artificial Sequence
  dgRNA
  Vdr
tgtggctggcggtcc

SEQ ID NO: 63657 - DNA, 15 bp, Artificial Sequence
  dgRNA
  Vdr
gcccctcacaaggca

SEQ ID NO: 63658 - DNA, 15 bp, Artificial Sequence
  dgRNA
  Vdr
aaggcgacagtgcag

SEQ ID NO: 63659 - DNA, 15 bp, Artificial Sequence
  dgRNA
  Vdr
tgaacttagtgggcg

SEQ ID NO: 63660 - DNA, 15 bp, Artificial Sequence
  dgRNA
  Agxt2
caaaggacgttagga

SEQ ID NO: 63661 - DNA, 15 bp, Artificial Sequence
  dgRNA
  Agxt2
gcagcaaaggacgtt

SEQ ID NO: 63662 - DNA, 15 bp, Artificial Sequence
  dgRNA
  Olfr704
agcacaaagtgtcat

SEQ ID NO: 63663 - DNA, 15 bp, Artificial Sequence
  dgRNA
  Suv420h1
ccgcctttcttgcgc

SEQ ID NO: 63664 - DNA, 15 bp, Artificial Sequence
  dgRNA
  Suv420h1
cggttgagcccgaag

SEQ ID NO: 63665 - DNA, 15 bp, Artificial Sequence
  dgRNA
  Suv420h1
ggttgagcccgaaga

SEQ ID NO: 63666 - DNA, 15 bp, Artificial Sequence
  dgRNA
  Suv420h1
ggagtggctgcgtcg

SEQ ID NO: 63667 - DNA, 15 bp, Artificial Sequence
  dgRNA
  Pcdh9
tgccgaggggcgctg

SEQ ID NO: 63668 - DNA, 15 bp, Artificial Sequence
  dgRNA
  Pcdh9
cgaggggcgctgggg

SEQ ID NO: 63669 - DNA, 15 bp, Artificial Sequence
  dgRNA
  Pcdh9
cgcactgcaagatgc

SEQ ID NO: 63670 - DNA, 15 bp, Artificial Sequence
  dgRNA
  Pcdh9
ccaatcaggacccgg

SEQ ID NO: 63671 - DNA, 15 bp, Artificial Sequence
  dgRNA
  Nipsnap1
tcgagatgaattccc

SEQ ID NO: 63672 - DNA, 15 bp, Artificial Sequence
  dgRNA
  Nipsnap1
gtttcaagagctcgg

SEQ ID NO: 63673 - DNA, 15 bp, Artificial Sequence
  dgRNA
  Nipsnap1
gtgcaactgtagagt

SEQ ID NO: 63674 - DNA, 15 bp, Artificial Sequence
  dgRNA
  Nipsnap1
tgcaactgtagagtt

SEQ ID NO: 63675 - DNA, 15 bp, Artificial Sequence
  dgRNA
  Dpp6
gctccctgatctggg

SEQ ID NO: 63676 - DNA, 15 bp, Artificial Sequence
  dgRNA
  Dpp6
catcctaatctcatg

SEQ ID NO: 63677 - DNA, 15 bp, Artificial Sequence
  dgRNA
  Dpp6
tagtcgccctcttgc

SEQ ID NO: 63678 - DNA, 15 bp, Artificial Sequence
  dgRNA
  Dpp6
gctggccaatccccc

SEQ ID NO: 63679 - DNA, 15 bp, Artificial Sequence
  dgRNA
  Krtap4-16
catctaacacttaca

SEQ ID NO: 63680 - DNA, 15 bp, Artificial Sequence
  dgRNA
  Krtap4-16
cctggtaacagtatc

SEQ ID NO: 63681 - DNA, 15 bp, Artificial Sequence
  dgRNA
  Krtap4-16
ctggtaacagtatca

SEQ ID NO: 63682 - DNA, 15 bp, Artificial Sequence
  dgRNA
  Krtap4-16
taaagtggctaatta

SEQ ID NO: 63683 - DNA, 15 bp, Artificial Sequence
  dgRNA
  Col13a1
ggacgggggctaccg

SEQ ID NO: 63684 - DNA, 15 bp, Artificial Sequence
  dgRNA
  Col13a1
gggggctaccgaggt

SEQ ID NO: 63685 - DNA, 15 bp, Artificial Sequence
  dgRNA
  Col13a1
ggctaccgaggtcgg

SEQ ID NO: 63686 - DNA, 15 bp, Artificial Sequence
  dgRNA
  Col13a1
gctaccgaggtcggc

SEQ ID NO: 63687 - DNA, 15 bp, Artificial Sequence
  dgRNA
  Mllt10
ggggacgagcggagt

SEQ ID NO: 63688 - DNA, 15 bp, Artificial Sequence
  dgRNA
  Ubxn1
cggctcaagcctgtc

SEQ ID NO: 63689 - DNA, 15 bp, Artificial Sequence
  dgRNA
  Ubxn1
ggagcttcttccccg

SEQ ID NO: 63690 - DNA, 15 bp, Artificial Sequence
  dgRNA
  Ubxn1
gagcttcttccccgt

SEQ ID NO: 63691 - DNA, 15 bp, Artificial Sequence
  dgRNA
  Ubxn1
ttcttccccgtgggt

SEQ ID NO: 63692 - DNA, 15 bp, Artificial Sequence
  dgRNA
  Patl1
cgcaactgtgcagtt

SEQ ID NO: 63693 - DNA, 15 bp, Artificial Sequence
  dgRNA
  Patl1
cagttaggaaaacgg

SEQ ID NO: 63694 - DNA, 15 bp, Artificial Sequence
  dgRNA
  Patl1
ttaggaaaacggagg

SEQ ID NO: 63695 - DNA, 15 bp, Artificial Sequence
  dgRNA
  Patl1
ggaggagccgcaagc

SEQ ID NO: 63696 - DNA, 15 bp, Artificial Sequence
  dgRNA
  Edaradd
gtgtagtgctcaccc

SEQ ID NO: 63697 - DNA, 15 bp, Artificial Sequence
  dgRNA
  Edaradd
tagtgctcacccagg

SEQ ID NO: 63698 - DNA, 15 bp, Artificial Sequence
  dgRNA
  Edaradd
aagtgctagcgtgtg

SEQ ID NO: 63699 - DNA, 15 bp, Artificial Sequence
  dgRNA
  Edaradd
gtcatgccgccgttc

SEQ ID NO: 63700 - DNA, 15 bp, Artificial Sequence
  dgRNA
  2300005B03Rik
atccctactccatgg

SEQ ID NO: 63701 - DNA, 15 bp, Artificial Sequence
  dgRNA
  2300005B03Rik
gtacctggctcccca

SEQ ID NO: 63702 - DNA, 15 bp, Artificial Sequence
  dgRNA
  2300005B03Rik
ggttgcaagtgactc

SEQ ID NO: 63703 - DNA, 15 bp, Artificial Sequence
  dgRNA
  2300005B03Rik
gttgcaagtgactca

SEQ ID NO: 63704 - DNA, 15 bp, Artificial Sequence
  dgRNA
  Rarres1
aattgcagcagccgc

SEQ ID NO: 63705 - DNA, 15 bp, Artificial Sequence
  dgRNA
  Rarres1
cggagtgtgccctca

SEQ ID NO: 63706 - DNA, 15 bp, Artificial Sequence
  dgRNA
  Rarres1
cctctcaccgcgtca

SEQ ID NO: 63707 - DNA, 15 bp, Artificial Sequence
  dgRNA
  Rarres1
ctctcaccgcgtcat

SEQ ID NO: 63708 - DNA, 15 bp, Artificial Sequence
  dgRNA
  Pqlc1
gggtgtgtgctaaat

SEQ ID NO: 63709 - DNA, 15 bp, Artificial Sequence
  dgRNA
  Pqlc1
gccctgaatattcca

SEQ ID NO: 63710 - DNA, 15 bp, Artificial Sequence
  dgRNA
  Pqlc1
gttaggagttacata

SEQ ID NO: 63711 - DNA, 15 bp, Artificial Sequence
  dgRNA
  Pqlc1
ggcaggaccgggtga

SEQ ID NO: 63712 - DNA, 15 bp, Artificial Sequence
  dgRNA
  Tmem8c
caagtgcataccaca

SEQ ID NO: 63713 - DNA, 15 bp, Artificial Sequence
  dgRNA
  Tmem8c
agctgatgtaccatg

SEQ ID NO: 63714 - DNA, 15 bp, Artificial Sequence
  dgRNA
  Olfr825
gcatcaaacatatga

SEQ ID NO: 63715 - DNA, 15 bp, Artificial Sequence
  dgRNA
  Olfr825
tgaatgctgtatcac

SEQ ID NO: 63716 - DNA, 15 bp, Artificial Sequence
  dgRNA
  Olfr825
gtttgtcatagtatg

SEQ ID NO: 63717 - DNA, 15 bp, Artificial Sequence
  dgRNA
  Mkl2
aggtgagagcgcggc

SEQ ID NO: 63718 - DNA, 15 bp, Artificial Sequence
  dgRNA
  Mkl2
agagcgcggcgggag

SEQ ID NO: 63719 - DNA, 15 bp, Artificial Sequence
  dgRNA
  Mkl2
gggcggcctcgcacc

SEQ ID NO: 63720 - DNA, 15 bp, Artificial Sequence
  dgRNA
  Mkl2
ggcggcctcgcacct

SEQ ID NO: 63721 - DNA, 15 bp, Artificial Sequence
  dgRNA
  Lrrfip2
cagataccaacgctc

SEQ ID NO: 63722 - DNA, 15 bp, Artificial Sequence
  dgRNA
  Lrrfip2
ccaacgctcgggacc

SEQ ID NO: 63723 - DNA, 15 bp, Artificial Sequence
  dgRNA
  Lrrfip2
gctcgggaccaggcc

SEQ ID NO: 63724 - DNA, 15 bp, Artificial Sequence
  dgRNA
  Lrrfip2
gagccctgcgctccg

SEQ ID NO: 63725 - DNA, 15 bp, Artificial Sequence
  dgRNA
  Klf3
tcacgcccagccccg

SEQ ID NO: 63726 - DNA, 15 bp, Artificial Sequence
  dgRNA
  Klf3
cgcgccgcgcctccc

SEQ ID NO: 63727 - DNA, 15 bp, Artificial Sequence
  dgRNA
  Klf3
cgcgcctcccgggac

SEQ ID NO: 63728 - DNA, 15 bp, Artificial Sequence
  dgRNA
  Klf3
cgggacaggtcgagc

SEQ ID NO: 63729 - DNA, 15 bp, Artificial Sequence
  dgRNA
  Vmn1r174
tggtgaattctacac

SEQ ID NO: 63730 - DNA, 15 bp, Artificial Sequence
  dgRNA
  Spata31
gcagatcttagattg

SEQ ID NO: 63731 - DNA, 15 bp, Artificial Sequence
  dgRNA
  Spata31
aactcatatattacc

SEQ ID NO: 63732 - DNA, 15 bp, Artificial Sequence
  dgRNA
  Rock2
cgcgccggggtgggc

SEQ ID NO: 63733 - DNA, 15 bp, Artificial Sequence
  dgRNA
  Rock2
gcgcgcagccgaccg

SEQ ID NO: 63734 - DNA, 15 bp, Artificial Sequence
  dgRNA
  Rock2
cgcgcagccgaccgc

SEQ ID NO: 63735 - DNA, 15 bp, Artificial Sequence
  dgRNA
  Rock2
gcagccgaccgcggg

SEQ ID NO: 63736 - DNA, 15 bp, Artificial Sequence
  dgRNA
  Olfr1330
gagttgtctagtcca

SEQ ID NO: 63737 - DNA, 15 bp, Artificial Sequence
  dgRNA
  Olfr1330
tcagtacctcacttt

SEQ ID NO: 63738 - DNA, 15 bp, Artificial Sequence
  dgRNA
  Olfr1330
gggagatataggccg

SEQ ID NO: 63739 - DNA, 15 bp, Artificial Sequence
  dgRNA
  Exoc2
ggtccatccagcact

SEQ ID NO: 63740 - DNA, 15 bp, Artificial Sequence
  dgRNA
  Exoc2
ccagcactcggtgct

SEQ ID NO: 63741 - DNA, 15 bp, Artificial Sequence
  dgRNA
  Exoc2
actcggtgctcggct

SEQ ID NO: 63742 - DNA, 15 bp, Artificial Sequence
  dgRNA
  Exoc2
cggtgctcggctagg

SEQ ID NO: 63743 - DNA, 15 bp, Artificial Sequence
  dgRNA
  Zfp799
tttatcgttcctttt

SEQ ID NO: 63744 - DNA, 15 bp, Artificial Sequence
  dgRNA
  Frem2
cgcagtttccccgcc

SEQ ID NO: 63745 - DNA, 15 bp, Artificial Sequence
  dgRNA
  Frem2
gcagtttccccgcct

SEQ ID NO: 63746 - DNA, 15 bp, Artificial Sequence
  dgRNA
  Frem2
ccagcgatcagcgat

SEQ ID NO: 63747 - DNA, 15 bp, Artificial Sequence
  dgRNA
  Frem2
gtcccctgagagaat

SEQ ID NO: 63748 - DNA, 15 bp, Artificial Sequence
  dgRNA
  Fxn
gatacgttgcgagtt

SEQ ID NO: 63749 - DNA, 15 bp, Artificial Sequence
  dgRNA
  Fxn
agtttggcgcagagc

SEQ ID NO: 63750 - DNA, 15 bp, Artificial Sequence
  dgRNA
  Fxn
gcgcagagcaggttc

SEQ ID NO: 63751 - DNA, 15 bp, Artificial Sequence
  dgRNA
  Fxn
cgcagagcaggttct

SEQ ID NO: 63752 - DNA, 15 bp, Artificial Sequence
  dgRNA
  Phkg1
tccccaggctccgcc

SEQ ID NO: 63753 - DNA, 15 bp, Artificial Sequence
  dgRNA
  Phkg1
atgtagttctgcccc

SEQ ID NO: 63754 - DNA, 15 bp, Artificial Sequence
  dgRNA
  Phkg1
acctggcggagcctg

SEQ ID NO: 63755 - DNA, 15 bp, Artificial Sequence
  dgRNA
  Phkg1
cacctggcggagcct

SEQ ID NO: 63756 - DNA, 15 bp, Artificial Sequence
  dgRNA
  C130074G19Rik
gcccgcacccgtagt

SEQ ID NO: 63757 - DNA, 15 bp, Artificial Sequence
  dgRNA
  C130074G19Rik
gcatttaaaactagc

SEQ ID NO: 63758 - DNA, 15 bp, Artificial Sequence
  dgRNA
  C130074G19Rik
gacctactacgggtg

SEQ ID NO: 63759 - DNA, 15 bp, Artificial Sequence
  dgRNA
  C130074G19Rik
caacagacctactac

SEQ ID NO: 63760 - DNA, 15 bp, Artificial Sequence
  dgRNA
  Clk4
tgcgcagccgcagtg

SEQ ID NO: 63761 - DNA, 15 bp, Artificial Sequence
  dgRNA
  Clk4
cccttgcacgatctg

SEQ ID NO: 63762 - DNA, 15 bp, Artificial Sequence
  dgRNA
  Clk4
ccttgcacgatctgt

SEQ ID NO: 63763 - DNA, 15 bp, Artificial Sequence
  dgRNA
  Clk4
tgcacgatctgtggg

SEQ ID NO: 63764 - DNA, 15 bp, Artificial Sequence
  dgRNA
  Haus1
gattataacacagag

SEQ ID NO: 63765 - DNA, 15 bp, Artificial Sequence
  dgRNA
  Haus1
aaatgcggcaaagcc

SEQ ID NO: 63766 - DNA, 15 bp, Artificial Sequence
  dgRNA
  Haus1
gaatccccggccccg

SEQ ID NO: 63767 - DNA, 15 bp, Artificial Sequence
  dgRNA
  Haus1
aatccccggccccga

SEQ ID NO: 63768 - DNA, 15 bp, Artificial Sequence
  dgRNA
  Arid1a
gcccggagcctgagc

SEQ ID NO: 63769 - DNA, 15 bp, Artificial Sequence
  dgRNA
  Arid1a
gagcctgagccggcg

SEQ ID NO: 63770 - DNA, 15 bp, Artificial Sequence
  dgRNA
  Arid1a
cctgagccggcgggg

SEQ ID NO: 63771 - DNA, 15 bp, Artificial Sequence
  dgRNA
  Arid1a
ctgagccggcggggc

SEQ ID NO: 63772 - DNA, 15 bp, Artificial Sequence
  dgRNA
  Tshz3
aacttcccattccgc

SEQ ID NO: 63773 - DNA, 15 bp, Artificial Sequence
  dgRNA
  Tshz3
attccgccggcagcg

SEQ ID NO: 63774 - DNA, 15 bp, Artificial Sequence
  dgRNA
  Tshz3
ttccctccgcacgtt

SEQ ID NO: 63775 - DNA, 15 bp, Artificial Sequence
  dgRNA
  Tshz3
tccctccgcacgttc

SEQ ID NO: 63776 - DNA, 15 bp, Artificial Sequence
  dgRNA
  Bcl11b
ggccggtgcaaaacc

SEQ ID NO: 63777 - DNA, 15 bp, Artificial Sequence
  dgRNA
  Bcl11b
aaaccggccagccag

SEQ ID NO: 63778 - DNA, 15 bp, Artificial Sequence
  dgRNA
  Bcl11b
cgcacttccacccaa

SEQ ID NO: 63779 - DNA, 15 bp, Artificial Sequence
  dgRNA
  Bcl11b
gcgcacttccaccca

SEQ ID NO: 63780 - DNA, 15 bp, Artificial Sequence
  dgRNA
  Cd82
gccgtttgattgaac

SEQ ID NO: 63781 - DNA, 15 bp, Artificial Sequence
  dgRNA
  Cd82
ccgtttgattgaacc

SEQ ID NO: 63782 - DNA, 15 bp, Artificial Sequence
  dgRNA
  Cd82
tttgattgaaccggg

SEQ ID NO: 63783 - DNA, 15 bp, Artificial Sequence
  dgRNA
  Cd82
ggtgctacctcccgc

SEQ ID NO: 63784 - DNA, 15 bp, Artificial Sequence
  dgRNA
  Mtmr2
attcccttacaaagc

SEQ ID NO: 63785 - DNA, 15 bp, Artificial Sequence
  dgRNA
  Mtmr2
gaacagacttacctc

SEQ ID NO: 63786 - DNA, 15 bp, Artificial Sequence
  dgRNA
  Lgals3
tgccatttctgcgga

SEQ ID NO: 63787 - DNA, 15 bp, Artificial Sequence
  dgRNA
  Lgals3
tctgcggaaggcttc

SEQ ID NO: 63788 - DNA, 15 bp, Artificial Sequence
  dgRNA
  Lgals3
gagtctgggtgcggt

SEQ ID NO: 63789 - DNA, 15 bp, Artificial Sequence
  dgRNA
  Lgals3
tgggtgcggtcggct

SEQ ID NO: 63790 - DNA, 15 bp, Artificial Sequence
  dgRNA
  Olfr1000
ttgaacacatctaat

SEQ ID NO: 63791 - DNA, 15 bp, Artificial Sequence
  dgRNA
  Defb4
tccttgacaagagac

SEQ ID NO: 63792 - DNA, 15 bp, Artificial Sequence
  dgRNA
  Defb4
cacaatagtaattac

SEQ ID NO: 63793 - DNA, 15 bp, Artificial Sequence
  dgRNA
  Defb4
gggttctagtcagtg

SEQ ID NO: 63794 - DNA, 15 bp, Artificial Sequence
  dgRNA
  Defb4
gtggattccaatgca

SEQ ID NO: 63795 - DNA, 15 bp, Artificial Sequence
  dgRNA
  Copb2
cagcagcgggagacg

SEQ ID NO: 63796 - DNA, 15 bp, Artificial Sequence
  dgRNA
  Copb2
aagtccgcgttacct

SEQ ID NO: 63797 - DNA, 15 bp, Artificial Sequence
  dgRNA
  Copb2
cgttacctaggaaac

SEQ ID NO: 63798 - DNA, 15 bp, Artificial Sequence
  dgRNA
  Copb2
gttacctaggaaact

SEQ ID NO: 63799 - DNA, 15 bp, Artificial Sequence
  dgRNA
  Nampt
gaccacgcccctcag

SEQ ID NO: 63800 - DNA, 15 bp, Artificial Sequence
  dgRNA
  Nampt
acgcccctcagaggc

SEQ ID NO: 63801 - DNA, 15 bp, Artificial Sequence
  dgRNA
  Nampt
gcccaggtcacgcgc

SEQ ID NO: 63802 - DNA, 15 bp, Artificial Sequence
  dgRNA
  Nampt
cccaggtcacgcgct

SEQ ID NO: 63803 - DNA, 15 bp, Artificial Sequence
  dgRNA
  Mier1
tcagaagtgaccgac

SEQ ID NO: 63804 - DNA, 15 bp, Artificial Sequence
  dgRNA
  Mier1
accgaccggtagaat

SEQ ID NO: 63805 - DNA, 15 bp, Artificial Sequence
  dgRNA
  Mier1
gaccggtagaatagg

SEQ ID NO: 63806 - DNA, 15 bp, Artificial Sequence
  dgRNA
  Mier1
aaagtgagtaccctg

SEQ ID NO: 63807 - DNA, 15 bp, Artificial Sequence
  dgRNA
  Mrpl2
catggctgccgctcg

SEQ ID NO: 63808 - DNA, 15 bp, Artificial Sequence
  dgRNA
  Mrpl2
gttttgacggctcca

SEQ ID NO: 63809 - DNA, 15 bp, Artificial Sequence
  dgRNA
  Mrpl2
ttttgacggctccaa

SEQ ID NO: 63810 - DNA, 15 bp, Artificial Sequence
  dgRNA
  Mrpl2
tttgacggctccaag

SEQ ID NO: 63811 - DNA, 15 bp, Artificial Sequence
  dgRNA
  Aspdh
tgctcaggaggccgt

SEQ ID NO: 63812 - DNA, 15 bp, Artificial Sequence
  dgRNA
  Aspdh
gctcaggaggccgtg

SEQ ID NO: 63813 - DNA, 15 bp, Artificial Sequence
  dgRNA
  Aspdh
aggccgtggggtagt

SEQ ID NO: 63814 - DNA, 15 bp, Artificial Sequence
  dgRNA
  Aspdh
ggtagtgggcacata

SEQ ID NO: 63815 - DNA, 15 bp, Artificial Sequence
  dgRNA
  Col17a1
aagggtatttcccat

SEQ ID NO: 63816 - DNA, 15 bp, Artificial Sequence
  dgRNA
  Col17a1
ttccccttttcccgc

SEQ ID NO: 63817 - DNA, 15 bp, Artificial Sequence
  dgRNA
  Col17a1
ccgcaggtctataaa

SEQ ID NO: 63818 - DNA, 15 bp, Artificial Sequence
  dgRNA
  Col17a1
ctacctgagctggca

SEQ ID NO: 63819 - DNA, 15 bp, Artificial Sequence
  dgRNA
  Olfr1420
aatcgctaagactct

SEQ ID NO: 63820 - DNA, 15 bp, Artificial Sequence
  dgRNA
  Fbn1
cgagaaaccgctgcg

SEQ ID NO: 63821 - DNA, 15 bp, Artificial Sequence
  dgRNA
  Fbn1
ggacgatacttgaag

SEQ ID NO: 63822 - DNA, 15 bp, Artificial Sequence
  dgRNA
  Fbn1
cgatacttgaagagg

SEQ ID NO: 63823 - DNA, 15 bp, Artificial Sequence
  dgRNA
  Fbn1
agggggccgcagagt

SEQ ID NO: 63824 - DNA, 15 bp, Artificial Sequence
  dgRNA
  Hist3h2ba
ctgccaatacacttt

SEQ ID NO: 63825 - DNA, 15 bp, Artificial Sequence
  dgRNA
  Hist3h2ba
aatacactttcggat

SEQ ID NO: 63826 - DNA, 15 bp, Artificial Sequence
  dgRNA
  Hist3h2ba
cactttcggattggt

SEQ ID NO: 63827 - DNA, 15 bp, Artificial Sequence
  dgRNA
  Hist3h2ba
actttcggattggtt

SEQ ID NO: 63828 - DNA, 15 bp, Artificial Sequence
  dgRNA
  Gfi1
gcgccctgaccccga

SEQ ID NO: 63829 - DNA, 15 bp, Artificial Sequence
  dgRNA
  Gfi1
cctgaccccgaaggt

SEQ ID NO: 63830 - DNA, 15 bp, Artificial Sequence
  dgRNA
  Gfi1
gcctcccgctcaggc

SEQ ID NO: 63831 - DNA, 15 bp, Artificial Sequence
  dgRNA
  Gfi1
cctcccgctcaggcg

SEQ ID NO: 63832 - DNA, 15 bp, Artificial Sequence
  dgRNA
  Gtf2e1
cagacgtgggttaag

SEQ ID NO: 63833 - DNA, 15 bp, Artificial Sequence
  dgRNA
  Gtf2e1
accttcacccgatcc

SEQ ID NO: 63834 - DNA, 15 bp, Artificial Sequence
  dgRNA
  Gtf2e1
ccttcacccgatcca

SEQ ID NO: 63835 - DNA, 15 bp, Artificial Sequence
  dgRNA
  Gtf2e1
gccacgatttccttg

SEQ ID NO: 63836 - DNA, 15 bp, Artificial Sequence
  dgRNA
  Zfp111
cccgaaaagcaactc

SEQ ID NO: 63837 - DNA, 15 bp, Artificial Sequence
  dgRNA
  Zfp111
gttaaaacagctagg

SEQ ID NO: 63838 - DNA, 15 bp, Artificial Sequence
  dgRNA
  Zfp111
caaactttagcattc

SEQ ID NO: 63839 - DNA, 15 bp, Artificial Sequence
  dgRNA
  Zfp111
tgcttttcgggattt

SEQ ID NO: 63840 - DNA, 15 bp, Artificial Sequence
  dgRNA
  Sult1c1
gaatgcggagctctc

SEQ ID NO: 63841 - DNA, 15 bp, Artificial Sequence
  dgRNA
  Sult1c1
tgtcccgccctaagc

SEQ ID NO: 63842 - DNA, 15 bp, Artificial Sequence
  dgRNA
  Sult1c1
ggctcctgtatttag

SEQ ID NO: 63843 - DNA, 15 bp, Artificial Sequence
  dgRNA
  Sult1c1
tcctgtatttagggg

SEQ ID NO: 63844 - DNA, 15 bp, Artificial Sequence
  dgRNA
  Vmn2r66
ttaagaatccgcaag

SEQ ID NO: 63845 - DNA, 15 bp, Artificial Sequence
  dgRNA
  Vmn2r66
cgcaagaggcaaaca

SEQ ID NO: 63846 - DNA, 15 bp, Artificial Sequence
  dgRNA
  Vmn2r66
gcactctatggcctt

SEQ ID NO: 63847 - DNA, 15 bp, Artificial Sequence
  dgRNA
  Papolg
gctgcaagtccgctg

SEQ ID NO: 63848 - DNA, 15 bp, Artificial Sequence
  dgRNA
  Papolg
gcaagtccgctgagg

SEQ ID NO: 63849 - DNA, 15 bp, Artificial Sequence
  dgRNA
  Papolg
caagtccgctgaggt

SEQ ID NO: 63850 - DNA, 15 bp, Artificial Sequence
  dgRNA
  Papolg
gtccgctgaggtggg

SEQ ID NO: 63851 - DNA, 15 bp, Artificial Sequence
  dgRNA
  A830010M20Rik
tcattgatgtagctt

SEQ ID NO: 63852 - DNA, 15 bp, Artificial Sequence
  dgRNA
  A830010M20Rik
ggagtaagtagattc

SEQ ID NO: 63853 - DNA, 15 bp, Artificial Sequence
  dgRNA
  A830010M20Rik
taagtagattcggga

SEQ ID NO: 63854 - DNA, 15 bp, Artificial Sequence
  dgRNA
  A830010M20Rik
cagggctttacgtgc

SEQ ID NO: 63855 - DNA, 15 bp, Artificial Sequence
  dgRNA
  Wnt3
tttgcccaagtttgc

SEQ ID NO: 63856 - DNA, 15 bp, Artificial Sequence
  dgRNA
  Wnt3
cagagccggagttgt

SEQ ID NO: 63857 - DNA, 15 bp, Artificial Sequence
  dgRNA
  Wnt3
ccggagttgtgggcc

SEQ ID NO: 63858 - DNA, 15 bp, Artificial Sequence
  dgRNA
  Wnt3
gagttgtgggccggg

SEQ ID NO: 63859 - DNA, 15 bp, Artificial Sequence
  dgRNA
  Wt1
caaggcgcctacact

SEQ ID NO: 63860 - DNA, 15 bp, Artificial Sequence
  dgRNA
  Wt1
aaggcgcctacactc

SEQ ID NO: 63861 - DNA, 15 bp, Artificial Sequence
  dgRNA
  Wt1
cgcctacactcggga

SEQ ID NO: 63862 - DNA, 15 bp, Artificial Sequence
  dgRNA
  Wt1
tcgggaaggccagct

SEQ ID NO: 63863 - DNA, 15 bp, Artificial Sequence
  dgRNA
  Phactr2
tacaggagccgcgcc

SEQ ID NO: 63864 - DNA, 15 bp, Artificial Sequence
  dgRNA
  Phactr2
caggagccgcgcctg

SEQ ID NO: 63865 - DNA, 15 bp, Artificial Sequence
  dgRNA
  Phactr2
aggagccgcgcctgg

SEQ ID NO: 63866 - DNA, 15 bp, Artificial Sequence
  dgRNA
  Phactr2
agccgcgcctggggg

SEQ ID NO: 63867 - DNA, 15 bp, Artificial Sequence
  dgRNA
  Arhgdia
cgcgcgacgctgctc

SEQ ID NO: 63868 - DNA, 15 bp, Artificial Sequence
  dgRNA
  Arhgdia
ctcgcacccggcatt

SEQ ID NO: 63869 - DNA, 15 bp, Artificial Sequence
  dgRNA
  Arhgdia
ccggcattcggcaga

SEQ ID NO: 63870 - DNA, 15 bp, Artificial Sequence
  dgRNA
  Arhgdia
tcggcagaaggcgcg

SEQ ID NO: 63871 - DNA, 15 bp, Artificial Sequence
  dgRNA
  0610040J01Rik
cccactaatagcctt

SEQ ID NO: 63872 - DNA, 15 bp, Artificial Sequence
  dgRNA
  0610040J01Rik
ccactaatagccttt

SEQ ID NO: 63873 - DNA, 15 bp, Artificial Sequence
  dgRNA
  0610040J01Rik
agattgtctagccat

SEQ ID NO: 63874 - DNA, 15 bp, Artificial Sequence
  dgRNA
  0610040J01Rik
gattgtctagccatc

SEQ ID NO: 63875 - DNA, 15 bp, Artificial Sequence
  dgRNA
  Tex37
ttattctgatccagt

SEQ ID NO: 63876 - DNA, 15 bp, Artificial Sequence
  dgRNA
  Tex37
tcctgagactcccgg

SEQ ID NO: 63877 - DNA, 15 bp, Artificial Sequence
  dgRNA
  Tex37
ctgagactcccggag

SEQ ID NO: 63878 - DNA, 15 bp, Artificial Sequence
  dgRNA
  Tex37
ccggaggggtaagac

SEQ ID NO: 63879 - DNA, 15 bp, Artificial Sequence
  dgRNA
  Klri2
gactgtatcagaact

SEQ ID NO: 63880 - DNA, 15 bp, Artificial Sequence
  dgRNA
  Klri2
actgtatcagaacta

SEQ ID NO: 63881 - DNA, 15 bp, Artificial Sequence
  dgRNA
  Klri2
tagggcatctctcac

SEQ ID NO: 63882 - DNA, 15 bp, Artificial Sequence
  dgRNA
  Klri2
tgaaaagcttgctac

SEQ ID NO: 63883 - DNA, 15 bp, Artificial Sequence
  dgRNA
  Wasl
gtctgcgcacgcgcg

SEQ ID NO: 63884 - DNA, 15 bp, Artificial Sequence
  dgRNA
  Wasl
gcgcgcggtggtcat

SEQ ID NO: 63885 - DNA, 15 bp, Artificial Sequence
  dgRNA
  Wasl
cgcggtggtcattgg

SEQ ID NO: 63886 - DNA, 15 bp, Artificial Sequence
  dgRNA
  Wasl
gcggtggtcattggt

SEQ ID NO: 63887 - DNA, 15 bp, Artificial Sequence
  dgRNA
  Necap2
gtttgaactacaacc

SEQ ID NO: 63888 - DNA, 15 bp, Artificial Sequence
  dgRNA
  Necap2
aactacaaccaggtt

SEQ ID NO: 63889 - DNA, 15 bp, Artificial Sequence
  dgRNA
  Necap2
actacaaccaggttc

SEQ ID NO: 63890 - DNA, 15 bp, Artificial Sequence
  dgRNA
  Necap2
accaggttcgggatt

SEQ ID NO: 63891 - DNA, 15 bp, Artificial Sequence
  dgRNA
  Fancd2os
cacaagtgtaaagca

SEQ ID NO: 63892 - DNA, 15 bp, Artificial Sequence
  dgRNA
  Fancd2os
cttcccccatgtcaa

SEQ ID NO: 63893 - DNA, 15 bp, Artificial Sequence
  dgRNA
  Fancd2os
ttgacaggggcatag

SEQ ID NO: 63894 - DNA, 15 bp, Artificial Sequence
  dgRNA
  Fancd2os
aggcgcccttctgga

SEQ ID NO: 63895 - DNA, 15 bp, Artificial Sequence
  dgRNA
  Btbd3
taatgagtgaactag

SEQ ID NO: 63896 - DNA, 15 bp, Artificial Sequence
  dgRNA
  Btbd3
tgagtgaactagagg

SEQ ID NO: 63897 - DNA, 15 bp, Artificial Sequence
  dgRNA
  Btbd3
gcaatttgtgggaca

SEQ ID NO: 63898 - DNA, 15 bp, Artificial Sequence
  dgRNA
  Btbd3
ccgcccactactctc

SEQ ID NO: 63899 - DNA, 15 bp, Artificial Sequence
  dgRNA
  Slc48a1
aatgatcattgtagc

SEQ ID NO: 63900 - DNA, 15 bp, Artificial Sequence
  dgRNA
  Slc48a1
cattgtagccggctc

SEQ ID NO: 63901 - DNA, 15 bp, Artificial Sequence
  dgRNA
  Slc48a1
cggctccggtaaaga

SEQ ID NO: 63902 - DNA, 15 bp, Artificial Sequence
  dgRNA
  Slc48a1
aaagacggtatttct

SEQ ID NO: 63903 - DNA, 15 bp, Artificial Sequence
  dgRNA
  Dnpep
gagagtaggcgtgac

SEQ ID NO: 63904 - DNA, 15 bp, Artificial Sequence
  dgRNA
  Dnpep
agagtaggcgtgacg

SEQ ID NO: 63905 - DNA, 15 bp, Artificial Sequence
  dgRNA
  Dnpep
gtaggcgtgacgggg

SEQ ID NO: 63906 - DNA, 15 bp, Artificial Sequence
  dgRNA
  Dnpep
gctagtggcgcaatg

SEQ ID NO: 63907 - DNA, 15 bp, Artificial Sequence
  dgRNA
  Ccdc92
cgcacgcatgcgtcc

SEQ ID NO: 63908 - DNA, 15 bp, Artificial Sequence
  dgRNA
  Ccdc92
gcacgcatgcgtccc

SEQ ID NO: 63909 - DNA, 15 bp, Artificial Sequence
  dgRNA
  Ccdc92
cacgcatgcgtcccg

SEQ ID NO: 63910 - DNA, 15 bp, Artificial Sequence
  dgRNA
  Ccdc92
cgcgcgttcccgctc

SEQ ID NO: 63911 - DNA, 15 bp, Artificial Sequence
  dgRNA
  Olfr1392
taatgcatctgatga

SEQ ID NO: 63912 - DNA, 15 bp, Artificial Sequence
  dgRNA
  Olfr1153
agaccaacagtttac

SEQ ID NO: 63913 - DNA, 15 bp, Artificial Sequence
  dgRNA
  Olfr1153
ttatatatcatggca

SEQ ID NO: 63914 - DNA, 15 bp, Artificial Sequence
  dgRNA
  Cbx5
aaagccttagcctcg

SEQ ID NO: 63915 - DNA, 15 bp, Artificial Sequence
  dgRNA
  Cbx5
tagcctcggggccaa

SEQ ID NO: 63916 - DNA, 15 bp, Artificial Sequence
  dgRNA
  Cbx5
ccccttagtctagta

SEQ ID NO: 63917 - DNA, 15 bp, Artificial Sequence
  dgRNA
  Cbx5
gtcatggcaacgaac

SEQ ID NO: 63918 - DNA, 15 bp, Artificial Sequence
  dgRNA
  C87499
aaaccctgaaccact

SEQ ID NO: 63919 - DNA, 15 bp, Artificial Sequence
  dgRNA
  C87499
ccttgactatccatc

SEQ ID NO: 63920 - DNA, 15 bp, Artificial Sequence
  dgRNA
  C87499
cagggtgtacgtaca

SEQ ID NO: 63921 - DNA, 15 bp, Artificial Sequence
  dgRNA
  C87499
gaatttttgaccaga

SEQ ID NO: 63922 - DNA, 15 bp, Artificial Sequence
  dgRNA
  Nupr1l
ttaaccagcgaaacc

SEQ ID NO: 63923 - DNA, 15 bp, Artificial Sequence
  dgRNA
  Nupr1l
acacaattccgcatc

SEQ ID NO: 63924 - DNA, 15 bp, Artificial Sequence
  dgRNA
  Nupr1l
gccacgccccctgtg

SEQ ID NO: 63925 - DNA, 15 bp, Artificial Sequence
  dgRNA
  Nupr1l
gagcgctccctacag

SEQ ID NO: 63926 - DNA, 15 bp, Artificial Sequence
  dgRNA
  Atp5sl
aattgcgaccgcact

SEQ ID NO: 63927 - DNA, 15 bp, Artificial Sequence
  dgRNA
  Atp5sl
attgcgaccgcactc

SEQ ID NO: 63928 - DNA, 15 bp, Artificial Sequence
  dgRNA
  Atp5sl
ttgcgaccgcactcg

SEQ ID NO: 63929 - DNA, 15 bp, Artificial Sequence
  dgRNA
  Atp5sl
tgcgaccgcactcgg

SEQ ID NO: 63930 - DNA, 15 bp, Artificial Sequence
  dgRNA
  Gm42416
aatagatcctacaga

SEQ ID NO: 63931 - DNA, 15 bp, Artificial Sequence
  dgRNA
  Gm42416
tttgctagtccgaat

SEQ ID NO: 63932 - DNA, 15 bp, Artificial Sequence
  dgRNA
  Gm42416
tccgaatcggaacaa

SEQ ID NO: 63933 - DNA, 15 bp, Artificial Sequence
  dgRNA
  Gm42416
gaatcggaacaatgg

SEQ ID NO: 63934 - DNA, 15 bp, Artificial Sequence
  dgRNA
  Smim10l1
aattacatcagctca

SEQ ID NO: 63935 - DNA, 15 bp, Artificial Sequence
  dgRNA
  Smim10l1
aaggatcaaaggtcg

SEQ ID NO: 63936 - DNA, 15 bp, Artificial Sequence
  dgRNA
  Smim10l1
ccgctgtccctttaa

SEQ ID NO: 63937 - DNA, 15 bp, Artificial Sequence
  dgRNA
  Smim10l1
taactgctagggaca

SEQ ID NO: 63938 - DNA, 15 bp, Artificial Sequence
  dgRNA
  Lrrc51
aatggcaatgcagat

SEQ ID NO: 63939 - DNA, 15 bp, Artificial Sequence
  dgRNA
  Lrrc51
gcaatgcagataggc

SEQ ID NO: 63940 - DNA, 15 bp, Artificial Sequence
  dgRNA
  Lrrc51
tagacactccatatc

SEQ ID NO: 63941 - DNA, 15 bp, Artificial Sequence
  dgRNA
  Lrrc51
gagcacccttatctt

SEQ ID NO: 63942 - DNA, 15 bp, Artificial Sequence
  dgRNA
  Gng12
gaggtcgggcggtcc

SEQ ID NO: 63943 - DNA, 15 bp, Artificial Sequence
  dgRNA
  Gng12
aggtcgggcggtccc

SEQ ID NO: 63944 - DNA, 15 bp, Artificial Sequence
  dgRNA
  Gng12
gcggtcccgggagcg

SEQ ID NO: 63945 - DNA, 15 bp, Artificial Sequence
  dgRNA
  Gng12
cggactcccaggcgg

SEQ ID NO: 63946 - DNA, 15 bp, Artificial Sequence
  dgRNA
  Trpc4
gcggagtgaggatgc

SEQ ID NO: 63947 - DNA, 15 bp, Artificial Sequence
  dgRNA
  Olfr806
agaggacttacatat

SEQ ID NO: 63948 - DNA, 15 bp, Artificial Sequence
  dgRNA
  Olfr806
gttctatcaagtcta

SEQ ID NO: 63949 - DNA, 15 bp, Artificial Sequence
  dgRNA
  Etv4
cggaagctgaagacc

SEQ ID NO: 63950 - DNA, 15 bp, Artificial Sequence
  dgRNA
  Cdc20b
ccgcgggctttttaa

SEQ ID NO: 63951 - DNA, 15 bp, Artificial Sequence
  dgRNA
  Cdc20b
ttaaaggttaccctg

SEQ ID NO: 63952 - DNA, 15 bp, Artificial Sequence
  dgRNA
  Cdc20b
tggggaatacgctcc

SEQ ID NO: 63953 - DNA, 15 bp, Artificial Sequence
  dgRNA
  Cdc20b
aggagcgagggtctc

SEQ ID NO: 63954 - DNA, 15 bp, Artificial Sequence
  dgRNA
  Wfdc1
accaaccactaccca

SEQ ID NO: 63955 - DNA, 15 bp, Artificial Sequence
  dgRNA
  Wfdc1
ctccccggcctgcgg

SEQ ID NO: 63956 - DNA, 15 bp, Artificial Sequence
  dgRNA
  Wfdc1
cccggcctgcggagg

SEQ ID NO: 63957 - DNA, 15 bp, Artificial Sequence
  dgRNA
  Wfdc1
ggtcactcgtgcaga

SEQ ID NO: 63958 - DNA, 15 bp, Artificial Sequence
  dgRNA
  1600015I10Rik
gacacaagtagcccg

SEQ ID NO: 63959 - DNA, 15 bp, Artificial Sequence
  dgRNA
  1600015I10Rik
acacaagtagcccga

SEQ ID NO: 63960 - DNA, 15 bp, Artificial Sequence
  dgRNA
  1600015I10Rik
cacaagtagcccgag

SEQ ID NO: 63961 - DNA, 15 bp, Artificial Sequence
  dgRNA
  1600015I10Rik
ggactaagtcttgtg

SEQ ID NO: 63962 - DNA, 15 bp, Artificial Sequence
  dgRNA
  Olfr485
tgttgctccaaattt

SEQ ID NO: 63963 - DNA, 15 bp, Artificial Sequence
  dgRNA
  Olfr485
aatttggagcaacaa

SEQ ID NO: 63964 - DNA, 15 bp, Artificial Sequence
  dgRNA
  Cml5
tccacgttaatccta

SEQ ID NO: 63965 - DNA, 15 bp, Artificial Sequence
  dgRNA
  Cml5
ggtttatgattaccc

SEQ ID NO: 63966 - DNA, 15 bp, Artificial Sequence
  dgRNA
  Cml5
accataggattaacg

SEQ ID NO: 63967 - DNA, 15 bp, Artificial Sequence
  dgRNA
  Cml5
ctttgtaatcaccat

SEQ ID NO: 63968 - DNA, 15 bp, Artificial Sequence
  dgRNA
  Gpsm1
cctcggcgtctcccg

SEQ ID NO: 63969 - DNA, 15 bp, Artificial Sequence
  dgRNA
  Gpsm1
tctcccgcggacgcg

SEQ ID NO: 63970 - DNA, 15 bp, Artificial Sequence
  dgRNA
  Gpsm1
cgcggacgcgcggac

SEQ ID NO: 63971 - DNA, 15 bp, Artificial Sequence
  dgRNA
  Gpsm1
gcgcggacaggcgga

SEQ ID NO: 63972 - DNA, 15 bp, Artificial Sequence
  dgRNA
  Nt5c3b
tatccggagccagcc

SEQ ID NO: 63973 - DNA, 15 bp, Artificial Sequence
  dgRNA
  Nt5c3b
gacgcgactagtgcg

SEQ ID NO: 63974 - DNA, 15 bp, Artificial Sequence
  dgRNA
  Nt5c3b
gacgcctgcgcagtg

SEQ ID NO: 63975 - DNA, 15 bp, Artificial Sequence
  dgRNA
  Nt5c3b
cgcagtgtggctgta

SEQ ID NO: 63976 - DNA, 15 bp, Artificial Sequence
  dgRNA
  Wdr73
tgtagctgacatcga

SEQ ID NO: 63977 - DNA, 15 bp, Artificial Sequence
  dgRNA
  Wdr73
tgacatcgatggatc

SEQ ID NO: 63978 - DNA, 15 bp, Artificial Sequence
  dgRNA
  Wdr73
tgcgtcgttttcacc

SEQ ID NO: 63979 - DNA, 15 bp, Artificial Sequence
  dgRNA
  Wdr73
ttccgccccagccag

SEQ ID NO: 63980 - DNA, 15 bp, Artificial Sequence
  dgRNA
  Ncor2
atgcgcgccccgcag

SEQ ID NO: 63981 - DNA, 15 bp, Artificial Sequence
  dgRNA
  Ncor2
agcggcccgcgcgtc

SEQ ID NO: 63982 - DNA, 15 bp, Artificial Sequence
  dgRNA
  Ncor2
gcggcccgcgcgtcc

SEQ ID NO: 63983 - DNA, 15 bp, Artificial Sequence
  dgRNA
  Ncor2
ccccgcgtcgtagcg

SEQ ID NO: 63984 - DNA, 15 bp, Artificial Sequence
  dgRNA
  Hint2
gaatatcccaccccc

SEQ ID NO: 63985 - DNA, 15 bp, Artificial Sequence
  dgRNA
  Hint2
gtttagtccttccaa

SEQ ID NO: 63986 - DNA, 15 bp, Artificial Sequence
  dgRNA
  Hint2
gtccttccaatggaa

SEQ ID NO: 63987 - DNA, 15 bp, Artificial Sequence
  dgRNA
  Hint2
agagtgaaactgcgt

SEQ ID NO: 63988 - DNA, 15 bp, Artificial Sequence
  dgRNA
  Fam132b
aagtggaggcgtgca

SEQ ID NO: 63989 - DNA, 15 bp, Artificial Sequence
  dgRNA
  Fam132b
gaggcgtgcacggac

SEQ ID NO: 63990 - DNA, 15 bp, Artificial Sequence
  dgRNA
  Fam132b
gtgcacggaccggat

SEQ ID NO: 63991 - DNA, 15 bp, Artificial Sequence
  dgRNA
  Fam132b
tgcacggaccggatc

SEQ ID NO: 63992 - DNA, 15 bp, Artificial Sequence
  dgRNA
  Yae1d1
agcctccaagccgca

SEQ ID NO: 63993 - DNA, 15 bp, Artificial Sequence
  dgRNA
  Yae1d1
gcctccaagccgcaa

SEQ ID NO: 63994 - DNA, 15 bp, Artificial Sequence
  dgRNA
  Yae1d1
cctccaagccgcaag

SEQ ID NO: 63995 - DNA, 15 bp, Artificial Sequence
  dgRNA
  Yae1d1
tcccgccccccgaac

SEQ ID NO: 63996 - DNA, 15 bp, Artificial Sequence
  dgRNA
  Pik3c2g
ccggctgtgtcttta

SEQ ID NO: 63997 - DNA, 15 bp, Artificial Sequence
  dgRNA
  Pik3c2g
gacagcgtcatttta

SEQ ID NO: 63998 - DNA, 15 bp, Artificial Sequence
  dgRNA
  Pik3c2g
acagcgtcattttat

SEQ ID NO: 63999 - DNA, 15 bp, Artificial Sequence
  dgRNA
  Pik3c2g
cgtcattttatgggc

SEQ ID NO: 64000 - DNA, 15 bp, Artificial Sequence
  dgRNA
  Akap17b
gttagaaccttgcaa

SEQ ID NO: 64001 - DNA, 15 bp, Artificial Sequence
  dgRNA
  Akap17b
gcttggctgtacagg

SEQ ID NO: 64002 - DNA, 15 bp, Artificial Sequence
  dgRNA
  Akap17b
ttggctgtacaggag

SEQ ID NO: 64003 - DNA, 15 bp, Artificial Sequence
  dgRNA
  Akap17b
tgtacaggaggggcg

SEQ ID NO: 64004 - DNA, 15 bp, Artificial Sequence
  dgRNA
  Tex101
cactccgggtagcaa

SEQ ID NO: 64005 - DNA, 15 bp, Artificial Sequence
  dgRNA
  Tex101
cgggtagcaacggcc

SEQ ID NO: 64006 - DNA, 15 bp, Artificial Sequence
  dgRNA
  Tex101
gggtagcaacggcca

SEQ ID NO: 64007 - DNA, 15 bp, Artificial Sequence
  dgRNA
  Tex101
ggtagcaacggccag

SEQ ID NO: 64008 - DNA, 15 bp, Artificial Sequence
  dgRNA
  Ube2b
aggcgaggtagcgtg

SEQ ID NO: 64009 - DNA, 15 bp, Artificial Sequence
  dgRNA
  Ube2b
ggcgaggtagcgtgt

SEQ ID NO: 64010 - DNA, 15 bp, Artificial Sequence
  dgRNA
  Ube2b
agcgtgtgggctccg

SEQ ID NO: 64011 - DNA, 15 bp, Artificial Sequence
  dgRNA
  Ube2b
gcgtgtgggctccga

SEQ ID NO: 64012 - DNA, 15 bp, Artificial Sequence
  dgRNA
  Zmiz1
acacttcaacttgct

SEQ ID NO: 64013 - DNA, 15 bp, Artificial Sequence
  dgRNA
  Zmiz1
caacttgctcggctc

SEQ ID NO: 64014 - DNA, 15 bp, Artificial Sequence
  dgRNA
  Zmiz1
aacttgctcggctcc

SEQ ID NO: 64015 - DNA, 15 bp, Artificial Sequence
  dgRNA
  Zmiz1
gtgaatcaactcgcc

SEQ ID NO: 64016 - DNA, 15 bp, Artificial Sequence
  dgRNA
  Dpm2
tttcccgacatgcac

SEQ ID NO: 64017 - DNA, 15 bp, Artificial Sequence
  dgRNA
  Dpm2
cccgacatgcactgg

SEQ ID NO: 64018 - DNA, 15 bp, Artificial Sequence
  dgRNA
  Dpm2
ccgacatgcactgga

SEQ ID NO: 64019 - DNA, 15 bp, Artificial Sequence
  dgRNA
  Dpm2
acgtgatttacaagc

SEQ ID NO: 64020 - DNA, 15 bp, Artificial Sequence
  dgRNA
  AI846148
cgccgccgagcaaac

SEQ ID NO: 64021 - DNA, 15 bp, Artificial Sequence
  dgRNA
  AI846148
acaaacgcgctgcac

SEQ ID NO: 64022 - DNA, 15 bp, Artificial Sequence
  dgRNA
  AI846148
caaacgcgctgcaca

SEQ ID NO: 64023 - DNA, 15 bp, Artificial Sequence
  dgRNA
  AI846148
cgctgcacagggttc

SEQ ID NO: 64024 - DNA, 15 bp, Artificial Sequence
  dgRNA
  Lats1
acactcaccccggct

SEQ ID NO: 64025 - DNA, 15 bp, Artificial Sequence
  dgRNA
  Lats1
actcaccccggctcg

SEQ ID NO: 64026 - DNA, 15 bp, Artificial Sequence
  dgRNA
  Lats1
cccggctcggggaag

SEQ ID NO: 64027 - DNA, 15 bp, Artificial Sequence
  dgRNA
  Lats1
ccggctcggggaagc

SEQ ID NO: 64028 - DNA, 15 bp, Artificial Sequence
  dgRNA
  3110040N11Rik
atggatcacaccctg

SEQ ID NO: 64029 - DNA, 15 bp, Artificial Sequence
  dgRNA
  3110040N11Rik
tgccatctcggggcg

SEQ ID NO: 64030 - DNA, 15 bp, Artificial Sequence
  dgRNA
  3110040N11Rik
catctcggggcgagg

SEQ ID NO: 64031 - DNA, 15 bp, Artificial Sequence
  dgRNA
  3110040N11Rik
cgaggtggcactctt

SEQ ID NO: 64032 - DNA, 15 bp, Artificial Sequence
  dgRNA
  Dmrta2
gagtttcgaatcttt

SEQ ID NO: 64033 - DNA, 15 bp, Artificial Sequence
  dgRNA
  Dmrta2
gaatgaggggctccc

SEQ ID NO: 64034 - DNA, 15 bp, Artificial Sequence
  dgRNA
  Dmrta2
aatgaggggctcccc

SEQ ID NO: 64035 - DNA, 15 bp, Artificial Sequence
  dgRNA
  Dmrta2
ggggctccccgggcg

SEQ ID NO: 64036 - DNA, 15 bp, Artificial Sequence
  dgRNA
  Lmnb2
cctccacccgcaatc

SEQ ID NO: 64037 - DNA, 15 bp, Artificial Sequence
  dgRNA
  Lmnb2
ctccacccgcaatca

SEQ ID NO: 64038 - DNA, 15 bp, Artificial Sequence
  dgRNA
  Lmnb2
gtaactgccaaaccc

SEQ ID NO: 64039 - DNA, 15 bp, Artificial Sequence
  dgRNA
  Lmnb2
aaccccgggttttac

SEQ ID NO: 64040 - DNA, 15 bp, Artificial Sequence
  dgRNA
  Wdr11
tgagtttcggaactt

SEQ ID NO: 64041 - DNA, 15 bp, Artificial Sequence
  dgRNA
  Wdr11
ttcggaactttggag

SEQ ID NO: 64042 - DNA, 15 bp, Artificial Sequence
  dgRNA
  Wdr11
tcggaactttggaga

SEQ ID NO: 64043 - DNA, 15 bp, Artificial Sequence
  dgRNA
  Wdr11
gagacgacggactat

SEQ ID NO: 64044 - DNA, 15 bp, Artificial Sequence
  dgRNA
  Prune2
cagctgccccgcgtc

SEQ ID NO: 64045 - DNA, 15 bp, Artificial Sequence
  dgRNA
  Prune2
agctgccccgcgtca

SEQ ID NO: 64046 - DNA, 15 bp, Artificial Sequence
  dgRNA
  Prune2
gcgtcagggcccccg

SEQ ID NO: 64047 - DNA, 15 bp, Artificial Sequence
  dgRNA
  Prune2
cgcgcgcgtgccagc

SEQ ID NO: 64048 - DNA, 15 bp, Artificial Sequence
  dgRNA
  Tspan17
gacagcggctaggca

SEQ ID NO: 64049 - DNA, 15 bp, Artificial Sequence
  dgRNA
  Tspan17
acagcggctaggcat

SEQ ID NO: 64050 - DNA, 15 bp, Artificial Sequence
  dgRNA
  Tspan17
gcggctaggcatggg

SEQ ID NO: 64051 - DNA, 15 bp, Artificial Sequence
  dgRNA
  Tspan17
aggattaagcccggc

SEQ ID NO: 64052 - DNA, 15 bp, Artificial Sequence
  dgRNA
  Esp34
accatgctagtttac

SEQ ID NO: 64053 - DNA, 15 bp, Artificial Sequence
  dgRNA
  Fam32a
ggcgagctatgttgt

SEQ ID NO: 64054 - DNA, 15 bp, Artificial Sequence
  dgRNA
  Fam32a
aagactacccgagac

SEQ ID NO: 64055 - DNA, 15 bp, Artificial Sequence
  dgRNA
  Fam32a
aagcgaggagggttt

SEQ ID NO: 64056 - DNA, 15 bp, Artificial Sequence
  dgRNA
  Fam32a
gaggagggtttcggc

SEQ ID NO: 64057 - DNA, 15 bp, Artificial Sequence
  dgRNA
  Als2cr12
cctcacatgtgatac

SEQ ID NO: 64058 - DNA, 15 bp, Artificial Sequence
  dgRNA
  Als2cr12
ccccaacattctgtt

SEQ ID NO: 64059 - DNA, 15 bp, Artificial Sequence
  dgRNA
  Als2cr12
atgaggtgccgccat

SEQ ID NO: 64060 - DNA, 15 bp, Artificial Sequence
  dgRNA
  Als2cr12
tgaggtgccgccatt

SEQ ID NO: 64061 - DNA, 15 bp, Artificial Sequence
  dgRNA
  Arhgap1
cttcttccgaccccc

SEQ ID NO: 64062 - DNA, 15 bp, Artificial Sequence
  dgRNA
  Arhgap1
cttttttctggcgtc

SEQ ID NO: 64063 - DNA, 15 bp, Artificial Sequence
  dgRNA
  Arhgap1
tggggttgggcaaat

SEQ ID NO: 64064 - DNA, 15 bp, Artificial Sequence
  dgRNA
  Arhgap1
gttgggcaaatcggt

SEQ ID NO: 64065 - DNA, 15 bp, Artificial Sequence
  dgRNA
  Gpatch11
agctccgctctgccg

SEQ ID NO: 64066 - DNA, 15 bp, Artificial Sequence
  dgRNA
  Gpatch11
gctccgctctgccga

SEQ ID NO: 64067 - DNA, 15 bp, Artificial Sequence
  dgRNA
  Gpatch11
ctctgccgagggacc

SEQ ID NO: 64068 - DNA, 15 bp, Artificial Sequence
  dgRNA
  Gpatch11
gcatgcgcgagacac

SEQ ID NO: 64069 - DNA, 15 bp, Artificial Sequence
  dgRNA
  Olfr172
ggaataacttcggca

SEQ ID NO: 64070 - DNA, 15 bp, Artificial Sequence
  dgRNA
  Olfr172
gaataacttcggcaa

SEQ ID NO: 64071 - DNA, 15 bp, Artificial Sequence
  dgRNA
  Olfr172
ctttttcaagtcagc

SEQ ID NO: 64072 - DNA, 15 bp, Artificial Sequence
  dgRNA
  Olfr172
tcattggttcaaagg

SEQ ID NO: 64073 - DNA, 15 bp, Artificial Sequence
  dgRNA
  Wdr4
agtttactttcacta

SEQ ID NO: 64074 - DNA, 15 bp, Artificial Sequence
  dgRNA
  Wdr4
ttcactagggtgtgt

SEQ ID NO: 64075 - DNA, 15 bp, Artificial Sequence
  dgRNA
  Wdr4
tcactagggtgtgtt

SEQ ID NO: 64076 - DNA, 15 bp, Artificial Sequence
  dgRNA
  2200002D01Rik
tacggaacggctttc

SEQ ID NO: 64077 - DNA, 15 bp, Artificial Sequence
  dgRNA
  2200002D01Rik
caagtacccccgcaa

SEQ ID NO: 64078 - DNA, 15 bp, Artificial Sequence
  dgRNA
  2200002D01Rik
aagtacccccgcaaa

SEQ ID NO: 64079 - DNA, 15 bp, Artificial Sequence
  dgRNA
  2200002D01Rik
gggacaaaggtccgg

SEQ ID NO: 64080 - DNA, 15 bp, Artificial Sequence
  dgRNA
  Ilf2
gccctccgctgtcag

SEQ ID NO: 64081 - DNA, 15 bp, Artificial Sequence
  dgRNA
  Ilf2
cctccgctgtcagtg

SEQ ID NO: 64082 - DNA, 15 bp, Artificial Sequence
  dgRNA
  Ilf2
cagggcatttttcat

SEQ ID NO: 64083 - DNA, 15 bp, Artificial Sequence
  dgRNA
  Ilf2
taaccaataaacgcg

SEQ ID NO: 64084 - DNA, 15 bp, Artificial Sequence
  dgRNA
  Ccr5
aactacacacttcgt

SEQ ID NO: 64085 - DNA, 15 bp, Artificial Sequence
  dgRNA
  Ccr5
cgtagtgttcagggt

SEQ ID NO: 64086 - DNA, 15 bp, Artificial Sequence
  dgRNA
  Ccr5
attacgtagtgttca

SEQ ID NO: 64087 - DNA, 15 bp, Artificial Sequence
  dgRNA
  Ccr5
tattacgtagtgttc

SEQ ID NO: 64088 - DNA, 15 bp, Artificial Sequence
  dgRNA
  Crispld2
agtagtagaaccggg

SEQ ID NO: 64089 - DNA, 15 bp, Artificial Sequence
  dgRNA
  Crispld2
gtagtagaaccgggt

SEQ ID NO: 64090 - DNA, 15 bp, Artificial Sequence
  dgRNA
  Crispld2
tagtagaaccgggtg

SEQ ID NO: 64091 - DNA, 15 bp, Artificial Sequence
  dgRNA
  Crispld2
ccgggtggggtccac

SEQ ID NO: 64092 - DNA, 15 bp, Artificial Sequence
  dgRNA
  Anapc15
cacttgactgcttgc

SEQ ID NO: 64093 - DNA, 15 bp, Artificial Sequence
  dgRNA
  Tbc1d22b
cccctgacgttgccg

SEQ ID NO: 64094 - DNA, 15 bp, Artificial Sequence
  dgRNA
  Tbc1d22b
ccctgacgttgccgc

SEQ ID NO: 64095 - DNA, 15 bp, Artificial Sequence
  dgRNA
  Tbc1d22b
gccgcgggccttcag

SEQ ID NO: 64096 - DNA, 15 bp, Artificial Sequence
  dgRNA
  Tbc1d22b
ccttcagcggcccgc

SEQ ID NO: 64097 - DNA, 15 bp, Artificial Sequence
  dgRNA
  Ifi27l2b
gtgttatcaggcagg

SEQ ID NO: 64098 - DNA, 15 bp, Artificial Sequence
  dgRNA
  Ifi27l2b
aggtaacgagataag

SEQ ID NO: 64099 - DNA, 15 bp, Artificial Sequence
  dgRNA
  Ifi27l2b
taacgagataagtgg

SEQ ID NO: 64100 - DNA, 15 bp, Artificial Sequence
  dgRNA
  Ifi27l2b
aacgagataagtgga

SEQ ID NO: 64101 - DNA, 15 bp, Artificial Sequence
  dgRNA
  Uba1
aagaagtcccaaact

SEQ ID NO: 64102 - DNA, 15 bp, Artificial Sequence
  dgRNA
  Uba1
tacatgattcatgag

SEQ ID NO: 64103 - DNA, 15 bp, Artificial Sequence
  dgRNA
  Uba1
attcatgagtgggcg

SEQ ID NO: 64104 - DNA, 15 bp, Artificial Sequence
  dgRNA
  Uba1
cggtcctcttgcatc

SEQ ID NO: 64105 - DNA, 15 bp, Artificial Sequence
  dgRNA
  Faf2
gggagatagatcggc

SEQ ID NO: 64106 - DNA, 15 bp, Artificial Sequence
  dgRNA
  Faf2
ggagatagatcggca

SEQ ID NO: 64107 - DNA, 15 bp, Artificial Sequence
  dgRNA
  Faf2
gggtcctgaattgtt

SEQ ID NO: 64108 - DNA, 15 bp, Artificial Sequence
  dgRNA
  Faf2
gcgaacgtcgccctc

SEQ ID NO: 64109 - DNA, 15 bp, Artificial Sequence
  dgRNA
  Tk2
aaatctacttgggtc

SEQ ID NO: 64110 - DNA, 15 bp, Artificial Sequence
  dgRNA
  Tk2
aatctacttgggtca

SEQ ID NO: 64111 - DNA, 15 bp, Artificial Sequence
  dgRNA
  Tk2
tctgcggtctgtaag

SEQ ID NO: 64112 - DNA, 15 bp, Artificial Sequence
  dgRNA
  Tk2
ctgcggtctgtaagt

SEQ ID NO: 64113 - DNA, 15 bp, Artificial Sequence
  dgRNA
  Calcb
ccagctatgacgtta

SEQ ID NO: 64114 - DNA, 15 bp, Artificial Sequence
  dgRNA
  Calcb
gacgttatggaagct

SEQ ID NO: 64115 - DNA, 15 bp, Artificial Sequence
  dgRNA
  Calcb
gaaccgggtaggagt

SEQ ID NO: 64116 - DNA, 15 bp, Artificial Sequence
  dgRNA
  Calcb
gctgaggaaccgggt

SEQ ID NO: 64117 - DNA, 15 bp, Artificial Sequence
  dgRNA
  Cpeb1
tccgaacggggggtg

SEQ ID NO: 64118 - DNA, 15 bp, Artificial Sequence
  dgRNA
  Cpeb1
gtccgaacggggggt

SEQ ID NO: 64119 - DNA, 15 bp, Artificial Sequence
  dgRNA
  Cpeb1
ggtccgaacgggggg

SEQ ID NO: 64120 - DNA, 15 bp, Artificial Sequence
  dgRNA
  Cpeb1
gggggtccgaacggg

SEQ ID NO: 64121 - DNA, 15 bp, Artificial Sequence
  dgRNA
  Galr2
tctggccggacatag

SEQ ID NO: 64122 - DNA, 15 bp, Artificial Sequence
  dgRNA
  Galr2
ggacatagtggcgca

SEQ ID NO: 64123 - DNA, 15 bp, Artificial Sequence
  dgRNA
  Galr2
caaaagggtgagtct

SEQ ID NO: 64124 - DNA, 15 bp, Artificial Sequence
  dgRNA
  Galr2
gagtctgggctagtt

SEQ ID NO: 64125 - DNA, 15 bp, Artificial Sequence
  dgRNA
  Usp3
ccgggagacggcgga

SEQ ID NO: 64126 - DNA, 15 bp, Artificial Sequence
  dgRNA
  Usp3
gcggatggcaaaacc

SEQ ID NO: 64127 - DNA, 15 bp, Artificial Sequence
  dgRNA
  Usp3
gcaaaacccggcgcc

SEQ ID NO: 64128 - DNA, 15 bp, Artificial Sequence
  dgRNA
  Usp3
ccatccgccgtctcc

SEQ ID NO: 64129 - DNA, 15 bp, Artificial Sequence
  dgRNA
  Dbndd2
ccaggagacgctgaa

SEQ ID NO: 64130 - DNA, 15 bp, Artificial Sequence
  dgRNA
  Dbndd2
caggagacgctgaaa

SEQ ID NO: 64131 - DNA, 15 bp, Artificial Sequence
  dgRNA
  Dbndd2
ggggctgtttccgac

SEQ ID NO: 64132 - DNA, 15 bp, Artificial Sequence
  dgRNA
  Dbndd2
gggctgtttccgact

SEQ ID NO: 64133 - DNA, 15 bp, Artificial Sequence
  dgRNA
  Wac
gcggggaccggaaca

SEQ ID NO: 64134 - DNA, 15 bp, Artificial Sequence
  dgRNA
  Wac
ccagccggccctaag

SEQ ID NO: 64135 - DNA, 15 bp, Artificial Sequence
  dgRNA
  Wac
gccggccctaagcgg

SEQ ID NO: 64136 - DNA, 15 bp, Artificial Sequence
  dgRNA
  Wac
cctaagcggtggtga

SEQ ID NO: 64137 - DNA, 15 bp, Artificial Sequence
  dgRNA
  Nadsyn1
tgcaggatctccgcg

SEQ ID NO: 64138 - DNA, 15 bp, Artificial Sequence
  dgRNA
  Nadsyn1
gcaggatctccgcgg

SEQ ID NO: 64139 - DNA, 15 bp, Artificial Sequence
  dgRNA
  Nadsyn1
ggatctccgcggggg

SEQ ID NO: 64140 - DNA, 15 bp, Artificial Sequence
  dgRNA
  Nadsyn1
gatctccgcgggggc

SEQ ID NO: 64141 - DNA, 15 bp, Artificial Sequence
  dgRNA
  Tssk5
caatcgcatgcagag

SEQ ID NO: 64142 - DNA, 15 bp, Artificial Sequence
  dgRNA
  Tssk5
acccagcattgggta

SEQ ID NO: 64143 - DNA, 15 bp, Artificial Sequence
  dgRNA
  Tssk5
taatccagagatgac

SEQ ID NO: 64144 - DNA, 15 bp, Artificial Sequence
  dgRNA
  Tssk5
atgacagggcttaag

SEQ ID NO: 64145 - DNA, 15 bp, Artificial Sequence
  dgRNA
  Bpnt1
agtcgcagctaagtt

SEQ ID NO: 64146 - DNA, 15 bp, Artificial Sequence
  dgRNA
  Bpnt1
gtcgcagctaagtta

SEQ ID NO: 64147 - DNA, 15 bp, Artificial Sequence
  dgRNA
  Bpnt1
tcgcagctaagttag

SEQ ID NO: 64148 - DNA, 15 bp, Artificial Sequence
  dgRNA
  Bpnt1
cacccaggaacggcc

SEQ ID NO: 64149 - DNA, 15 bp, Artificial Sequence
  dgRNA
  Traf3ip2
gatacagtcctgcac

SEQ ID NO: 64150 - DNA, 15 bp, Artificial Sequence
  dgRNA
  Traf3ip2
ttgccccatagttac

SEQ ID NO: 64151 - DNA, 15 bp, Artificial Sequence
  dgRNA
  Traf3ip2
gcagcaaatctgttt

SEQ ID NO: 64152 - DNA, 15 bp, Artificial Sequence
  dgRNA
  Traf3ip2
gggcctgataatggg

SEQ ID NO: 64153 - DNA, 15 bp, Artificial Sequence
  dgRNA
  Psme2
ggggctgtccaaggg

SEQ ID NO: 64154 - DNA, 15 bp, Artificial Sequence
  dgRNA
  Bsg
cttatagagccgcag

SEQ ID NO: 64155 - DNA, 15 bp, Artificial Sequence
  dgRNA
  Bsg
ttatagagccgcagt

SEQ ID NO: 64156 - DNA, 15 bp, Artificial Sequence
  dgRNA
  Bsg
tatagagccgcagtg

SEQ ID NO: 64157 - DNA, 15 bp, Artificial Sequence
  dgRNA
  Bsg
tgcggctctataaga

SEQ ID NO: 64158 - DNA, 15 bp, Artificial Sequence
  dgRNA
  Tpk1
gtactaagcaccccg

SEQ ID NO: 64159 - DNA, 15 bp, Artificial Sequence
  dgRNA
  Tpk1
tgctagaagctacgc

SEQ ID NO: 64160 - DNA, 15 bp, Artificial Sequence
  dgRNA
  Tpk1
tagaagctacgcagg

SEQ ID NO: 64161 - DNA, 15 bp, Artificial Sequence
  dgRNA
  Tpk1
acgcaggcggcagcc

SEQ ID NO: 64162 - DNA, 15 bp, Artificial Sequence
  dgRNA
  Rps28
aaatccttcccggcc

SEQ ID NO: 64163 - DNA, 15 bp, Artificial Sequence
  dgRNA
  Rps28
cttcccggcccggat

SEQ ID NO: 64164 - DNA, 15 bp, Artificial Sequence
  dgRNA
  Rps28
ggataacgcgagtag

SEQ ID NO: 64165 - DNA, 15 bp, Artificial Sequence
  dgRNA
  Rps28
gacgactctgtcccg

SEQ ID NO: 64166 - DNA, 15 bp, Artificial Sequence
  dgRNA
  Taf7l
ataaaaatctttgcg

SEQ ID NO: 64167 - DNA, 15 bp, Artificial Sequence
  dgRNA
  Taf7l
aacgctcgagcattc

SEQ ID NO: 64168 - DNA, 15 bp, Artificial Sequence
  dgRNA
  Taf7l
tcacgtggtataaga

SEQ ID NO: 64169 - DNA, 15 bp, Artificial Sequence
  dgRNA
  Taf7l
gtcacgtggtataag

SEQ ID NO: 64170 - DNA, 15 bp, Artificial Sequence
  dgRNA
  Speer3
tggctatagccatac

SEQ ID NO: 64171 - DNA, 15 bp, Artificial Sequence
  dgRNA
  Speer3
ctatagccatactgg

SEQ ID NO: 64172 - DNA, 15 bp, Artificial Sequence
  dgRNA
  Speer3
tatagccatactggt

SEQ ID NO: 64173 - DNA, 15 bp, Artificial Sequence
  dgRNA
  Krt75
atgccattttctgcg

SEQ ID NO: 64174 - DNA, 15 bp, Artificial Sequence
  dgRNA
  Krt75
ttctgcggggtactc

SEQ ID NO: 64175 - DNA, 15 bp, Artificial Sequence
  dgRNA
  Krt75
tctgcggggtactca

SEQ ID NO: 64176 - DNA, 15 bp, Artificial Sequence
  dgRNA
  Krt75
ctggcagatgcctag

SEQ ID NO: 64177 - DNA, 15 bp, Artificial Sequence
  dgRNA
  Olfr876
tttaccccttcattc

SEQ ID NO: 64178 - DNA, 15 bp, Artificial Sequence
  dgRNA
  Olfr876
agtacaaacctcctt

SEQ ID NO: 64179 - DNA, 15 bp, Artificial Sequence
  dgRNA
  Olfr876
tctagaacacggtaa

SEQ ID NO: 64180 - DNA, 15 bp, Artificial Sequence
  dgRNA
  Olfr876
ttctagaacacggta

SEQ ID NO: 64181 - DNA, 15 bp, Artificial Sequence
  dgRNA
  Lasp1
ttctccagcgcggga

SEQ ID NO: 64182 - DNA, 15 bp, Artificial Sequence
  dgRNA
  Lasp1
tctccagcgcgggaa

SEQ ID NO: 64183 - DNA, 15 bp, Artificial Sequence
  dgRNA
  Lasp1
gcgcgggaagggcca

SEQ ID NO: 64184 - DNA, 15 bp, Artificial Sequence
  dgRNA
  Lasp1
gcccgggcccgtcct

SEQ ID NO: 64185 - DNA, 15 bp, Artificial Sequence
  dgRNA
  Clybl
gcgcagggctcgcag

SEQ ID NO: 64186 - DNA, 15 bp, Artificial Sequence
  dgRNA
  Clybl
gggctcgcagaggat

SEQ ID NO: 64187 - DNA, 15 bp, Artificial Sequence
  dgRNA
  Clybl
cgcagaggattggag

SEQ ID NO: 64188 - DNA, 15 bp, Artificial Sequence
  dgRNA
  Clybl
ttggagtggctaacg

SEQ ID NO: 64189 - DNA, 15 bp, Artificial Sequence
  dgRNA
  Zswim4
cttgcgacctcttat

SEQ ID NO: 64190 - DNA, 15 bp, Artificial Sequence
  dgRNA
  Zswim4
cgacctcttattgga

SEQ ID NO: 64191 - DNA, 15 bp, Artificial Sequence
  dgRNA
  Zswim4
cagaaaagacggacg

SEQ ID NO: 64192 - DNA, 15 bp, Artificial Sequence
  dgRNA
  Zswim4
ttgtcgaatgaacag

SEQ ID NO: 64193 - DNA, 15 bp, Artificial Sequence
  dgRNA
  Rab22a
cacccgccgccatct

SEQ ID NO: 64194 - DNA, 15 bp, Artificial Sequence
  dgRNA
  Rab22a
acccgccgccatctt

SEQ ID NO: 64195 - DNA, 15 bp, Artificial Sequence
  dgRNA
  Rab22a
ccgccatcttgggac

SEQ ID NO: 64196 - DNA, 15 bp, Artificial Sequence
  dgRNA
  Rab22a
ccatcttgggacggg

SEQ ID NO: 64197 - DNA, 15 bp, Artificial Sequence
  dgRNA
  Nek5
tttattatagagcgg

SEQ ID NO: 64198 - DNA, 15 bp, Artificial Sequence
  dgRNA
  Nek5
tatagagcggaggag

SEQ ID NO: 64199 - DNA, 15 bp, Artificial Sequence
  dgRNA
  Nek5
atagagcggaggagc

SEQ ID NO: 64200 - DNA, 15 bp, Artificial Sequence
  dgRNA
  Nek5
ggagcgggaagaccc

SEQ ID NO: 64201 - DNA, 15 bp, Artificial Sequence
  dgRNA
  Mcf2l
gacaaattcgacaac

SEQ ID NO: 64202 - DNA, 15 bp, Artificial Sequence
  dgRNA
  Mcf2l
gccatttctctaagt

SEQ ID NO: 64203 - DNA, 15 bp, Artificial Sequence
  dgRNA
  Mcf2l
gtgggcactcccctg

SEQ ID NO: 64204 - DNA, 15 bp, Artificial Sequence
  dgRNA
  Mcf2l
tgggcactcccctgt

SEQ ID NO: 64205 - DNA, 15 bp, Artificial Sequence
  dgRNA
  Ptchd1
tcccgaggcgcggcg

SEQ ID NO: 64206 - DNA, 15 bp, Artificial Sequence
  dgRNA
  Ptchd1
cccgaggcgcggcgc

SEQ ID NO: 64207 - DNA, 15 bp, Artificial Sequence
  dgRNA
  Ptchd1
cgcgggactccccga

SEQ ID NO: 64208 - DNA, 15 bp, Artificial Sequence
  dgRNA
  Ptchd1
gggactccccgatgg

SEQ ID NO: 64209 - DNA, 15 bp, Artificial Sequence
  dgRNA
  Pcyox1l
aagaacccgcatccc

SEQ ID NO: 64210 - DNA, 15 bp, Artificial Sequence
  dgRNA
  Pcyox1l
aacccgcatcccagg

SEQ ID NO: 64211 - DNA, 15 bp, Artificial Sequence
  dgRNA
  Pcyox1l
ccgcatcccaggagg

SEQ ID NO: 64212 - DNA, 15 bp, Artificial Sequence
  dgRNA
  Pcyox1l
cgcatcccaggagga

SEQ ID NO: 64213 - DNA, 15 bp, Artificial Sequence
  dgRNA
  Suv39h2
ccgcatgaagaatca

SEQ ID NO: 64214 - DNA, 15 bp, Artificial Sequence
  dgRNA
  Suv39h2
gtaacaagccagcga

SEQ ID NO: 64215 - DNA, 15 bp, Artificial Sequence
  dgRNA
  Suv39h2
taacaagccagcgac

SEQ ID NO: 64216 - DNA, 15 bp, Artificial Sequence
  dgRNA
  Suv39h2
aagccagcgacgggc

SEQ ID NO: 64217 - DNA, 15 bp, Artificial Sequence
  dgRNA
  Ccr6
ctatagtccactagg

SEQ ID NO: 64218 - DNA, 15 bp, Artificial Sequence
  dgRNA
  Ccr6
gtccactaggtggac

SEQ ID NO: 64219 - DNA, 15 bp, Artificial Sequence
  dgRNA
  Ccr6
ccgtatttttgctac

SEQ ID NO: 64220 - DNA, 15 bp, Artificial Sequence
  dgRNA
  Ccr6
gtcctgtccacctag

SEQ ID NO: 64221 - DNA, 15 bp, Artificial Sequence
  dgRNA
  Ptp4a3
gcgcgcacgtcctga

SEQ ID NO: 64222 - DNA, 15 bp, Artificial Sequence
  dgRNA
  Ptp4a3
gtcctgacggcgccg

SEQ ID NO: 64223 - DNA, 15 bp, Artificial Sequence
  dgRNA
  Ptp4a3
ccctccgcgtcgtgc

SEQ ID NO: 64224 - DNA, 15 bp, Artificial Sequence
  dgRNA
  Ptp4a3
gcgtcgtgccggcgc

SEQ ID NO: 64225 - DNA, 15 bp, Artificial Sequence
  dgRNA
  Olfr352
tctccaaaagttata

SEQ ID NO: 64226 - DNA, 15 bp, Artificial Sequence
  dgRNA
  Olfr352
aaggtagtgatcttc

SEQ ID NO: 64227 - DNA, 15 bp, Artificial Sequence
  dgRNA
  Olfr352
ttggcaatactaaca

SEQ ID NO: 64228 - DNA, 15 bp, Artificial Sequence
  dgRNA
  Olfr1337
tcgatgtcatgtgtc

SEQ ID NO: 64229 - DNA, 15 bp, Artificial Sequence
  dgRNA
  Atf5
acacctgctggggcg

SEQ ID NO: 64230 - DNA, 15 bp, Artificial Sequence
  dgRNA
  Atf5
tagcactagcactac

SEQ ID NO: 64231 - DNA, 15 bp, Artificial Sequence
  dgRNA
  Atf5
agcactagcactaca

SEQ ID NO: 64232 - DNA, 15 bp, Artificial Sequence
  dgRNA
  Atf5
gcactagcactacag

SEQ ID NO: 64233 - DNA, 15 bp, Artificial Sequence
  dgRNA
  Ift172
ggaccgaagacttgt

SEQ ID NO: 64234 - DNA, 15 bp, Artificial Sequence
  dgRNA
  Ift172
ccgaagacttgtggg

SEQ ID NO: 64235 - DNA, 15 bp, Artificial Sequence
  dgRNA
  Ift172
aagacttgtgggcgg

SEQ ID NO: 64236 - DNA, 15 bp, Artificial Sequence
  dgRNA
  Ift172
gcggaggtttgcgtt

SEQ ID NO: 64237 - DNA, 15 bp, Artificial Sequence
  dgRNA
  Mettl9
tctatcgaataaacc

SEQ ID NO: 64238 - DNA, 15 bp, Artificial Sequence
  dgRNA
  Mettl9
ctatcgaataaacct

SEQ ID NO: 64239 - DNA, 15 bp, Artificial Sequence
  dgRNA
  Mettl9
gaacaattaggtcaa

SEQ ID NO: 64240 - DNA, 15 bp, Artificial Sequence
  dgRNA
  Mettl9
tcaaaggtgtaatcg

SEQ ID NO: 64241 - DNA, 15 bp, Artificial Sequence
  dgRNA
  Usp36
cactcgcgtacaccg

SEQ ID NO: 64242 - DNA, 15 bp, Artificial Sequence
  dgRNA
  Usp36
actcgcgtacaccgc

SEQ ID NO: 64243 - DNA, 15 bp, Artificial Sequence
  dgRNA
  Usp36
acgccaagccgcagc

SEQ ID NO: 64244 - DNA, 15 bp, Artificial Sequence
  dgRNA
  Usp36
cgccaagccgcagca

SEQ ID NO: 64245 - DNA, 15 bp, Artificial Sequence
  dgRNA
  Miox
tgtgcccccaacaag

SEQ ID NO: 64246 - DNA, 15 bp, Artificial Sequence
  dgRNA
  Miox
gtgcccccaacaaga

SEQ ID NO: 64247 - DNA, 15 bp, Artificial Sequence
  dgRNA
  Miox
gcagctattaaggca

SEQ ID NO: 64248 - DNA, 15 bp, Artificial Sequence
  dgRNA
  Miox
agctattaaggcaag

SEQ ID NO: 64249 - DNA, 15 bp, Artificial Sequence
  dgRNA
  Llgl1
tagctcagtcgtgag

SEQ ID NO: 64250 - DNA, 15 bp, Artificial Sequence
  dgRNA
  Llgl1
ccagcttcccacggt

SEQ ID NO: 64251 - DNA, 15 bp, Artificial Sequence
  dgRNA
  Llgl1
gttgggacccacctt

SEQ ID NO: 64252 - DNA, 15 bp, Artificial Sequence
  dgRNA
  Llgl1
cccccccggcgagcc

SEQ ID NO: 64253 - DNA, 15 bp, Artificial Sequence
  dgRNA
  Pdcd6
tgggtcggcccctca

SEQ ID NO: 64254 - DNA, 15 bp, Artificial Sequence
  dgRNA
  Pdcd6
cggcccctcatggcg

SEQ ID NO: 64255 - DNA, 15 bp, Artificial Sequence
  dgRNA
  Pdcd6
cacccgccgcagctt

SEQ ID NO: 64256 - DNA, 15 bp, Artificial Sequence
  dgRNA
  Pdcd6
acccgccgcagcttc

SEQ ID NO: 64257 - DNA, 15 bp, Artificial Sequence
  dgRNA
  Osbpl7
tcaggtgtaattgag

SEQ ID NO: 64258 - DNA, 15 bp, Artificial Sequence
  dgRNA
  Osbpl7
ccttgagtgttcact

SEQ ID NO: 64259 - DNA, 15 bp, Artificial Sequence
  dgRNA
  Osbpl7
atcctttaccttcga

SEQ ID NO: 64260 - DNA, 15 bp, Artificial Sequence
  dgRNA
  Osbpl7
gatatcaggttgact

SEQ ID NO: 64261 - DNA, 15 bp, Artificial Sequence
  dgRNA
  Smdt1
attcaagtcttcccg

SEQ ID NO: 64262 - DNA, 15 bp, Artificial Sequence
  dgRNA
  Smdt1
agtcttcccgaggtg

SEQ ID NO: 64263 - DNA, 15 bp, Artificial Sequence
  dgRNA
  Smdt1
gtcttcccgaggtga

SEQ ID NO: 64264 - DNA, 15 bp, Artificial Sequence
  dgRNA
  Smdt1
tcttcccgaggtgag

SEQ ID NO: 64265 - DNA, 15 bp, Artificial Sequence
  dgRNA
  Amfr
cgctcgtggcttcag

SEQ ID NO: 64266 - DNA, 15 bp, Artificial Sequence
  dgRNA
  Amfr
gctcgtggcttcagt

SEQ ID NO: 64267 - DNA, 15 bp, Artificial Sequence
  dgRNA
  Amfr
ggcccagggtcgcca

SEQ ID NO: 64268 - DNA, 15 bp, Artificial Sequence
  dgRNA
  Amfr
cagggggccgggacg

SEQ ID NO: 64269 - DNA, 15 bp, Artificial Sequence
  dgRNA
  Aars
gcatcagccgagccc

SEQ ID NO: 64270 - DNA, 15 bp, Artificial Sequence
  dgRNA
  Aars
cgcgctccgaatgat

SEQ ID NO: 64271 - DNA, 15 bp, Artificial Sequence
  dgRNA
  Aars
tgattggcatgccag

SEQ ID NO: 64272 - DNA, 15 bp, Artificial Sequence
  dgRNA
  Aars
gatgacaaggcgtag

SEQ ID NO: 64273 - DNA, 15 bp, Artificial Sequence
  dgRNA
  Myom3
tttaagacggttaca

SEQ ID NO: 64274 - DNA, 15 bp, Artificial Sequence
  dgRNA
  Myom3
gcggtgacaatggat

SEQ ID NO: 64275 - DNA, 15 bp, Artificial Sequence
  dgRNA
  Myom3
tgcggtgacaatgga

SEQ ID NO: 64276 - DNA, 15 bp, Artificial Sequence
  dgRNA
  Myom3
acagtgcggtgacaa

SEQ ID NO: 64277 - DNA, 15 bp, Artificial Sequence
  dgRNA
  Car13
gcaggaaatccccat

SEQ ID NO: 64278 - DNA, 15 bp, Artificial Sequence
  dgRNA
  Car13
ctcgggcgccccctg

SEQ ID NO: 64279 - DNA, 15 bp, Artificial Sequence
  dgRNA
  Car13
tgacgaccgtgccct

SEQ ID NO: 64280 - DNA, 15 bp, Artificial Sequence
  dgRNA
  Car13
gacgaccgtgccctc

SEQ ID NO: 64281 - DNA, 15 bp, Artificial Sequence
  dgRNA
  Olfr730
tatatcttatcaaag

SEQ ID NO: 64282 - DNA, 15 bp, Artificial Sequence
  dgRNA
  Olfr730
ggattcataggtagt

SEQ ID NO: 64283 - DNA, 15 bp, Artificial Sequence
  dgRNA
  Gtf2a1
atacacaacttcacg

SEQ ID NO: 64284 - DNA, 15 bp, Artificial Sequence
  dgRNA
  Gtf2a1
ccaagccccagcgcg

SEQ ID NO: 64285 - DNA, 15 bp, Artificial Sequence
  dgRNA
  Gtf2a1
caagccccagcgcgc

SEQ ID NO: 64286 - DNA, 15 bp, Artificial Sequence
  dgRNA
  Gtf2a1
ccagcgcgcgggagc

SEQ ID NO: 64287 - DNA, 15 bp, Artificial Sequence
  dgRNA
  Tgds
ctaatttctcctagc

SEQ ID NO: 64288 - DNA, 15 bp, Artificial Sequence
  dgRNA
  Tgds
ctagctggtgactat

SEQ ID NO: 64289 - DNA, 15 bp, Artificial Sequence
  dgRNA
  Tgds
gcgcagtgccactgc

SEQ ID NO: 64290 - DNA, 15 bp, Artificial Sequence
  dgRNA
  Tgds
gctccgcccctcttt

SEQ ID NO: 64291 - DNA, 15 bp, Artificial Sequence
  dgRNA
  BC003331
gtcatgggtcacggc

SEQ ID NO: 64292 - DNA, 15 bp, Artificial Sequence
  dgRNA
  BC003331
gcagggtgtctcgac

SEQ ID NO: 64293 - DNA, 15 bp, Artificial Sequence
  dgRNA
  BC003331
tgtctcgacaggctc

SEQ ID NO: 64294 - DNA, 15 bp, Artificial Sequence
  dgRNA
  BC003331
gtctcgacaggctct

SEQ ID NO: 64295 - DNA, 15 bp, Artificial Sequence
  dgRNA
  Dnajc14
cccccccggtgaccc

SEQ ID NO: 64296 - DNA, 15 bp, Artificial Sequence
  dgRNA
  Dnajc14
cggtgaccccggaag

SEQ ID NO: 64297 - DNA, 15 bp, Artificial Sequence
  dgRNA
  Dnajc14
ggaagtaagcggccg

SEQ ID NO: 64298 - DNA, 15 bp, Artificial Sequence
  dgRNA
  Dnajc14
agtaagcggccgtgg

SEQ ID NO: 64299 - DNA, 15 bp, Artificial Sequence
  dgRNA
  Tnip2
cacctagaatggagc

SEQ ID NO: 64300 - DNA, 15 bp, Artificial Sequence
  dgRNA
  Tnip2
agatcatagagtagg

SEQ ID NO: 64301 - DNA, 15 bp, Artificial Sequence
  dgRNA
  Tnip2
gatcatagagtagga

SEQ ID NO: 64302 - DNA, 15 bp, Artificial Sequence
  dgRNA
  Tnip2
acggagtcagactcc

SEQ ID NO: 64303 - DNA, 15 bp, Artificial Sequence
  dgRNA
  Ostc
tattatataccttcc

SEQ ID NO: 64304 - DNA, 15 bp, Artificial Sequence
  dgRNA
  Ostc
tttaggcttgagtgt

SEQ ID NO: 64305 - DNA, 15 bp, Artificial Sequence
  dgRNA
  Ostc
ataatggtcgttttt

SEQ ID NO: 64306 - DNA, 15 bp, Artificial Sequence
  dgRNA
  Ostc
taagccgaggaccac

SEQ ID NO: 64307 - DNA, 15 bp, Artificial Sequence
  dgRNA
  Ctss
aggtcattctattga

SEQ ID NO: 64308 - DNA, 15 bp, Artificial Sequence
  dgRNA
  Ctss
acatcggttctgaga

SEQ ID NO: 64309 - DNA, 15 bp, Artificial Sequence
  dgRNA
  Lyzl6
cctctttagaaacta

SEQ ID NO: 64310 - DNA, 15 bp, Artificial Sequence
  dgRNA
  Lyzl6
aaccggcatatttcc

SEQ ID NO: 64311 - DNA, 15 bp, Artificial Sequence
  dgRNA
  Lyzl6
gtaaggcggaccaat

SEQ ID NO: 64312 - DNA, 15 bp, Artificial Sequence
  dgRNA
  Lyzl6
tgtaaggcggaccaa

SEQ ID NO: 64313 - DNA, 15 bp, Artificial Sequence
  dgRNA
  Trex1
aggagcgtcagcacg

SEQ ID NO: 64314 - DNA, 15 bp, Artificial Sequence
  dgRNA
  Trex1
ggagcgtcagcacga

SEQ ID NO: 64315 - DNA, 15 bp, Artificial Sequence
  dgRNA
  Trex1
gtcagcacgagggcc

SEQ ID NO: 64316 - DNA, 15 bp, Artificial Sequence
  dgRNA
  Trex1
tggcaggctaacagc

SEQ ID NO: 64317 - DNA, 15 bp, Artificial Sequence
  dgRNA
  Olfr978
taacaggggtatgaa

SEQ ID NO: 64318 - DNA, 15 bp, Artificial Sequence
  dgRNA
  Olfr978
aatcaacaattcctt

SEQ ID NO: 64319 - DNA, 15 bp, Artificial Sequence
  dgRNA
  Mfap2
ttgaggtcaactccc

SEQ ID NO: 64320 - DNA, 15 bp, Artificial Sequence
  dgRNA
  Mfap2
caaatcagagtggtg

SEQ ID NO: 64321 - DNA, 15 bp, Artificial Sequence
  dgRNA
  Mfap2
tgttggaattggacg

SEQ ID NO: 64322 - DNA, 15 bp, Artificial Sequence
  dgRNA
  Mfap2
gttggaattggacgc

SEQ ID NO: 64323 - DNA, 15 bp, Artificial Sequence
  dgRNA
  Kif26a
actcaactaacaggt

SEQ ID NO: 64324 - DNA, 15 bp, Artificial Sequence
  dgRNA
  Kif26a
ctcaactaacaggtt

SEQ ID NO: 64325 - DNA, 15 bp, Artificial Sequence
  dgRNA
  Kif26a
tcaactaacaggttg

SEQ ID NO: 64326 - DNA, 15 bp, Artificial Sequence
  dgRNA
  Kif26a
caactaacaggttgg

SEQ ID NO: 64327 - DNA, 15 bp, Artificial Sequence
  dgRNA
  Rnf138
aaaatctctgcggaa

SEQ ID NO: 64328 - DNA, 15 bp, Artificial Sequence
  dgRNA
  Rnf138
aaatctctgcggaaa

SEQ ID NO: 64329 - DNA, 15 bp, Artificial Sequence
  dgRNA
  Rnf138
atctctgcggaaagg

SEQ ID NO: 64330 - DNA, 15 bp, Artificial Sequence
  dgRNA
  Rnf138
gaaacgcaatccata

SEQ ID NO: 64331 - DNA, 15 bp, Artificial Sequence
  dgRNA
  Msra
gacaatcgctctgat

SEQ ID NO: 64332 - DNA, 15 bp, Artificial Sequence
  dgRNA
  Msra
cgctctgattggcca

SEQ ID NO: 64333 - DNA, 15 bp, Artificial Sequence
  dgRNA
  Msra
tgcatgagcatcccg

SEQ ID NO: 64334 - DNA, 15 bp, Artificial Sequence
  dgRNA
  Msra
agatcccgagtcaca

SEQ ID NO: 64335 - DNA, 15 bp, Artificial Sequence
  dgRNA
  Otub1
ggtccttagccccgc

SEQ ID NO: 64336 - DNA, 15 bp, Artificial Sequence
  dgRNA
  Otub1
gccccgcaggacctt

SEQ ID NO: 64337 - DNA, 15 bp, Artificial Sequence
  dgRNA
  Otub1
ccccgcaggaccttt

SEQ ID NO: 64338 - DNA, 15 bp, Artificial Sequence
  dgRNA
  Otub1
atgtggaagcgcgcg

SEQ ID NO: 64339 - DNA, 15 bp, Artificial Sequence
  dgRNA
  Mfap3
gtcgaggagtacttc

SEQ ID NO: 64340 - DNA, 15 bp, Artificial Sequence
  dgRNA
  Mfap3
tcgaggagtacttcc

SEQ ID NO: 64341 - DNA, 15 bp, Artificial Sequence
  dgRNA
  Mfap3
ggaagtactcctcga

SEQ ID NO: 64342 - DNA, 15 bp, Artificial Sequence
  dgRNA
  Olfr1352
gtgagcaatgaggtc

SEQ ID NO: 64343 - DNA, 15 bp, Artificial Sequence
  dgRNA
  Olfr1002
tccctaatgattagt

SEQ ID NO: 64344 - DNA, 15 bp, Artificial Sequence
  dgRNA
  Olfr1002
tcctactaatcatta

SEQ ID NO: 64345 - DNA, 15 bp, Artificial Sequence
  dgRNA
  Olfr1002
ttcctactaatcatt

SEQ ID NO: 64346 - DNA, 15 bp, Artificial Sequence
  dgRNA
  Kcnh3
ccagccccgacggtg

SEQ ID NO: 64347 - DNA, 15 bp, Artificial Sequence
  dgRNA
  Kcnh3
cgcccccttgtgcgc

SEQ ID NO: 64348 - DNA, 15 bp, Artificial Sequence
  dgRNA
  Kcnh3
tgcgccggcagctgc

SEQ ID NO: 64349 - DNA, 15 bp, Artificial Sequence
  dgRNA
  Kcnh3
gcgccggcagctgct

SEQ ID NO: 64350 - DNA, 15 bp, Artificial Sequence
  dgRNA
  Rspo2
ccgtcagtactcttt

SEQ ID NO: 64351 - DNA, 15 bp, Artificial Sequence
  dgRNA
  Rspo2
actctttaggacctc

SEQ ID NO: 64352 - DNA, 15 bp, Artificial Sequence
  dgRNA
  Rspo2
aaacccgagcgtttc

SEQ ID NO: 64353 - DNA, 15 bp, Artificial Sequence
  dgRNA
  Rspo2
agcgtttctggcttt

SEQ ID NO: 64354 - DNA, 15 bp, Artificial Sequence
  dgRNA
  1700020A23Rik
gaatggtcacccaag

SEQ ID NO: 64355 - DNA, 15 bp, Artificial Sequence
  dgRNA
  1700020A23Rik
agatttggacactct

SEQ ID NO: 64356 - DNA, 15 bp, Artificial Sequence
  dgRNA
  1700020A23Rik
tagatttggacactc

SEQ ID NO: 64357 - DNA, 15 bp, Artificial Sequence
  dgRNA
  1700020A23Rik
tgaccattctagatt

SEQ ID NO: 64358 - DNA, 15 bp, Artificial Sequence
  dgRNA
  Elf2
ctccgtgtacagctg

SEQ ID NO: 64359 - DNA, 15 bp, Artificial Sequence
  dgRNA
  Elf2
tccgtgtacagctgc

SEQ ID NO: 64360 - DNA, 15 bp, Artificial Sequence
  dgRNA
  Elf2
tacagctgcgggact

SEQ ID NO: 64361 - DNA, 15 bp, Artificial Sequence
  dgRNA
  Elf2
gcgggactaggtatg

SEQ ID NO: 64362 - DNA, 15 bp, Artificial Sequence
  dgRNA
  Hist1h4i
aatgaatgagccgct

SEQ ID NO: 64363 - DNA, 15 bp, Artificial Sequence
  dgRNA
  Hist1h4i
gagccgctaggctcc

SEQ ID NO: 64364 - DNA, 15 bp, Artificial Sequence
  dgRNA
  Hist1h4i
agccgctaggctcct

SEQ ID NO: 64365 - DNA, 15 bp, Artificial Sequence
  dgRNA
  Hist1h4i
tgtataggatgtaag

SEQ ID NO: 64366 - DNA, 15 bp, Artificial Sequence
  dgRNA
  Spint4
atggagctcactatc

SEQ ID NO: 64367 - DNA, 15 bp, Artificial Sequence
  dgRNA
  Spint4
gagttgaatcagtct

SEQ ID NO: 64368 - DNA, 15 bp, Artificial Sequence
  dgRNA
  Spint4
ggtactcatgcactc

SEQ ID NO: 64369 - DNA, 15 bp, Artificial Sequence
  dgRNA
  Spint4
agtaatgctgaaccc

SEQ ID NO: 64370 - DNA, 15 bp, Artificial Sequence
  dgRNA
  Hspa4l
tgccccgcggctccg

SEQ ID NO: 64371 - DNA, 15 bp, Artificial Sequence
  dgRNA
  Hspa4l
gttgccgagcgctga

SEQ ID NO: 64372 - DNA, 15 bp, Artificial Sequence
  dgRNA
  Hspa4l
ttgccgagcgctgac

SEQ ID NO: 64373 - DNA, 15 bp, Artificial Sequence
  dgRNA
  Hspa4l
gagcgctgacgggag

SEQ ID NO: 64374 - DNA, 15 bp, Artificial Sequence
  dgRNA
  Gngt2
agtctgtcatcctcc

SEQ ID NO: 64375 - DNA, 15 bp, Artificial Sequence
  dgRNA
  Gngt2
aatgtcccttgctat

SEQ ID NO: 64376 - DNA, 15 bp, Artificial Sequence
  dgRNA
  Gngt2
catagtggtgtcagg

SEQ ID NO: 64377 - DNA, 15 bp, Artificial Sequence
  dgRNA
  Tmprss13
tattagctgagtaac

SEQ ID NO: 64378 - DNA, 15 bp, Artificial Sequence
  dgRNA
  Tmprss13
attagctgagtaact

SEQ ID NO: 64379 - DNA, 15 bp, Artificial Sequence
  dgRNA
  Tmprss13
aggtctggcgagttc

SEQ ID NO: 64380 - DNA, 15 bp, Artificial Sequence
  dgRNA
  Tmprss13
ccgccccatctgctg

SEQ ID NO: 64381 - DNA, 15 bp, Artificial Sequence
  dgRNA
  Rtp1
gtctagccttttgtc

SEQ ID NO: 64382 - DNA, 15 bp, Artificial Sequence
  dgRNA
  Rtp1
gcccccaaactatct

SEQ ID NO: 64383 - DNA, 15 bp, Artificial Sequence
  dgRNA
  Rtp1
ctgtagactgcaatc

SEQ ID NO: 64384 - DNA, 15 bp, Artificial Sequence
  dgRNA
  Rtp1
tgtagactgcaatca

SEQ ID NO: 64385 - DNA, 15 bp, Artificial Sequence
  dgRNA
  Psmd1
atgtccgttcgcagc

SEQ ID NO: 64386 - DNA, 15 bp, Artificial Sequence
  dgRNA
  Psmd1
ttgcatgatctcgag

SEQ ID NO: 64387 - DNA, 15 bp, Artificial Sequence
  dgRNA
  Psmd1
catgatctcgagagg

SEQ ID NO: 64388 - DNA, 15 bp, Artificial Sequence
  dgRNA
  Psmd1
ataaaagacacagcg

SEQ ID NO: 64389 - DNA, 15 bp, Artificial Sequence
  dgRNA
  Galnt13
gcctcgcaggagccg

SEQ ID NO: 64390 - DNA, 15 bp, Artificial Sequence
  dgRNA
  Galnt13
caggagccgcggctc

SEQ ID NO: 64391 - DNA, 15 bp, Artificial Sequence
  dgRNA
  Galnt13
aggagccgcggctcc

SEQ ID NO: 64392 - DNA, 15 bp, Artificial Sequence
  dgRNA
  Galnt13
cagctggagcgcgct

SEQ ID NO: 64393 - DNA, 15 bp, Artificial Sequence
  dgRNA
  Mapt
aggttcgcgctcccg

SEQ ID NO: 64394 - DNA, 15 bp, Artificial Sequence
  dgRNA
  Mapt
gcctgcgctgcccgc

SEQ ID NO: 64395 - DNA, 15 bp, Artificial Sequence
  dgRNA
  Mapt
cagaacgcgctttct

SEQ ID NO: 64396 - DNA, 15 bp, Artificial Sequence
  dgRNA
  Mapt
acctccctaggggag

SEQ ID NO: 64397 - DNA, 15 bp, Artificial Sequence
  dgRNA
  Olfr930
gttgcacatgaaagg

SEQ ID NO: 64398 - DNA, 15 bp, Artificial Sequence
  dgRNA
  Olfr930
aaggaggcatattca

SEQ ID NO: 64399 - DNA, 15 bp, Artificial Sequence
  dgRNA
  Olfr930
gaggcatattcatgg

SEQ ID NO: 64400 - DNA, 15 bp, Artificial Sequence
  dgRNA
  Tyr
acatagcccatagtg

SEQ ID NO: 64401 - DNA, 15 bp, Artificial Sequence
  dgRNA
  Pikfyve
taccgcgtaagcctc

SEQ ID NO: 64402 - DNA, 15 bp, Artificial Sequence
  dgRNA
  Pikfyve
accgcgtaagcctct

SEQ ID NO: 64403 - DNA, 15 bp, Artificial Sequence
  dgRNA
  Pikfyve
tctcggcgcgaccgc

SEQ ID NO: 64404 - DNA, 15 bp, Artificial Sequence
  dgRNA
  Pikfyve
gcccagaggcttacg

SEQ ID NO: 64405 - DNA, 15 bp, Artificial Sequence
  dgRNA
  Ptger3
tgtcacgtaacccaa

SEQ ID NO: 64406 - DNA, 15 bp, Artificial Sequence
  dgRNA
  Ptger3
cagacctagggggcg

SEQ ID NO: 64407 - DNA, 15 bp, Artificial Sequence
  dgRNA
  Ptger3
agggggcgcggcgcc

SEQ ID NO: 64408 - DNA, 15 bp, Artificial Sequence
  dgRNA
  Ptger3
tcgagctccaaggcg

SEQ ID NO: 64409 - DNA, 15 bp, Artificial Sequence
  dgRNA
  Leo1
cgcacagcgtgcgag

SEQ ID NO: 64410 - DNA, 15 bp, Artificial Sequence
  dgRNA
  Leo1
gcacagcgtgcgagc

SEQ ID NO: 64411 - DNA, 15 bp, Artificial Sequence
  dgRNA
  Leo1
gtgcgagcgggctaa

SEQ ID NO: 64412 - DNA, 15 bp, Artificial Sequence
  dgRNA
  Leo1
gggctaacggagtag

SEQ ID NO: 64413 - DNA, 15 bp, Artificial Sequence
  dgRNA
  Nol10
ctagtgcctccgccc

SEQ ID NO: 64414 - DNA, 15 bp, Artificial Sequence
  dgRNA
  Nol10
tagtgcctccgccct

SEQ ID NO: 64415 - DNA, 15 bp, Artificial Sequence
  dgRNA
  Nol10
agtgcctccgccctg

SEQ ID NO: 64416 - DNA, 15 bp, Artificial Sequence
  dgRNA
  Nol10
gtgagcgcgcacttc

SEQ ID NO: 64417 - DNA, 15 bp, Artificial Sequence
  dgRNA
  BC030336
aatctttaagatctc

SEQ ID NO: 64418 - DNA, 15 bp, Artificial Sequence
  dgRNA
  BC030336
agcagccccgagcgc

SEQ ID NO: 64419 - DNA, 15 bp, Artificial Sequence
  dgRNA
  BC030336
gcagccccgagcgcc

SEQ ID NO: 64420 - DNA, 15 bp, Artificial Sequence
  dgRNA
  BC030336
gagccgacgccccct

SEQ ID NO: 64421 - DNA, 15 bp, Artificial Sequence
  dgRNA
  BC089491
aaacgcatgagtgtc

SEQ ID NO: 64422 - DNA, 15 bp, Artificial Sequence
  dgRNA
  BC089491
aacgcatgagtgtca

SEQ ID NO: 64423 - DNA, 15 bp, Artificial Sequence
  dgRNA
  BC089491
ggggcggtgtctatt

SEQ ID NO: 64424 - DNA, 15 bp, Artificial Sequence
  dgRNA
  BC089491
acagcagcgcctccc

SEQ ID NO: 64425 - DNA, 15 bp, Artificial Sequence
  dgRNA
  Akr1b7
ttacgatgatcagtg

SEQ ID NO: 64426 - DNA, 15 bp, Artificial Sequence
  dgRNA
  Akr1b7
tcatgccccaaccct

SEQ ID NO: 64427 - DNA, 15 bp, Artificial Sequence
  dgRNA
  Akr1b7
ggctgcttgccaatg

SEQ ID NO: 64428 - DNA, 15 bp, Artificial Sequence
  dgRNA
  Akr1b7
ccgcctcctttatcc

SEQ ID NO: 64429 - DNA, 15 bp, Artificial Sequence
  dgRNA
  Rxrb
catggcggcgccccg

SEQ ID NO: 64430 - DNA, 15 bp, Artificial Sequence
  dgRNA
  Rxrb
atggcggcgccccga

SEQ ID NO: 64431 - DNA, 15 bp, Artificial Sequence
  dgRNA
  Rxrb
gcggcgccccgaggg

SEQ ID NO: 64432 - DNA, 15 bp, Artificial Sequence
  dgRNA
  Rxrb
agggcggcgcggcca

SEQ ID NO: 64433 - DNA, 15 bp, Artificial Sequence
  dgRNA
  Kcnab2
gtcacttttgcgtca

SEQ ID NO: 64434 - DNA, 15 bp, Artificial Sequence
  dgRNA
  Kcnab2
tgcgtcaaggccgcg

SEQ ID NO: 64435 - DNA, 15 bp, Artificial Sequence
  dgRNA
  Kcnab2
cgccaatccacgcat

SEQ ID NO: 64436 - DNA, 15 bp, Artificial Sequence
  dgRNA
  Kcnab2
caatccacgcatcgg

SEQ ID NO: 64437 - DNA, 15 bp, Artificial Sequence
  dgRNA
  Ugt1a5
attgatcgggcacca

SEQ ID NO: 64438 - DNA, 15 bp, Artificial Sequence
  dgRNA
  Ugt1a5
ttaatgtctgggagc

SEQ ID NO: 64439 - DNA, 15 bp, Artificial Sequence
  dgRNA
  Ugt1a5
cccagtggcgtgaca

SEQ ID NO: 64440 - DNA, 15 bp, Artificial Sequence
  dgRNA
  Ugt1a5
gtggcgtgacaaggt

SEQ ID NO: 64441 - DNA, 15 bp, Artificial Sequence
  dgRNA
  Syt15
tgatgcggggtggcc

SEQ ID NO: 64442 - DNA, 15 bp, Artificial Sequence
  dgRNA
  Clk4
ttaaggcgggcttcc

SEQ ID NO: 64443 - DNA, 15 bp, Artificial Sequence
  dgRNA
  Clk4
tctgcggcgcgcgtc

SEQ ID NO: 64444 - DNA, 15 bp, Artificial Sequence
  dgRNA
  Clk4
gtctgcggcgcgcgt

SEQ ID NO: 64445 - DNA, 15 bp, Artificial Sequence
  dgRNA
  Clk4
cccgccttaagtctg

SEQ ID NO: 64446 - DNA, 15 bp, Artificial Sequence
  dgRNA
  Noxo1
agcccgccggctcgc

SEQ ID NO: 64447 - DNA, 15 bp, Artificial Sequence
  dgRNA
  Noxo1
gcccgccggctcgct

SEQ ID NO: 64448 - DNA, 15 bp, Artificial Sequence
  dgRNA
  Noxo1
catcttgctggcgtg

SEQ ID NO: 64449 - DNA, 15 bp, Artificial Sequence
  dgRNA
  Noxo1
atcttgctggcgtgc

SEQ ID NO: 64450 - DNA, 15 bp, Artificial Sequence
  dgRNA
  Myc
ccgccctttatattc

SEQ ID NO: 64451 - DNA, 15 bp, Artificial Sequence
  dgRNA
  Myc
cgccctttatattcc

SEQ ID NO: 64452 - DNA, 15 bp, Artificial Sequence
  dgRNA
  Myc
gccctttatattccg

SEQ ID NO: 64453 - DNA, 15 bp, Artificial Sequence
  dgRNA
  Myc
ccctttatattccgg

SEQ ID NO: 64454 - DNA, 15 bp, Artificial Sequence
  dgRNA
  Olfr168
catgatcacaattca

SEQ ID NO: 64455 - DNA, 15 bp, Artificial Sequence
  dgRNA
  Olfr168
ccatgatcacaattc

SEQ ID NO: 64456 - DNA, 15 bp, Artificial Sequence
  dgRNA
  Usp9y
agtactaggaactta

SEQ ID NO: 64457 - DNA, 15 bp, Artificial Sequence
  dgRNA
  Usp9y
tcactagtttctaac

SEQ ID NO: 64458 - DNA, 15 bp, Artificial Sequence
  dgRNA
  Usp9y
accggaaaatatatt

SEQ ID NO: 64459 - DNA, 15 bp, Artificial Sequence
  dgRNA
  Usp9y
aatcgcagctagaaa

SEQ ID NO: 64460 - DNA, 15 bp, Artificial Sequence
  dgRNA
  Slco6c1
gccgcatcattctgt

SEQ ID NO: 64461 - DNA, 15 bp, Artificial Sequence
  dgRNA
  Slco6c1
ccgcatcattctgta

SEQ ID NO: 64462 - DNA, 15 bp, Artificial Sequence
  dgRNA
  Slco6c1
attctgtagggacgt

SEQ ID NO: 64463 - DNA, 15 bp, Artificial Sequence
  dgRNA
  Slco6c1
taacgtttcctgcag

SEQ ID NO: 64464 - DNA, 15 bp, Artificial Sequence
  dgRNA
  Scrt1
cagctgagcgcgccc

SEQ ID NO: 64465 - DNA, 15 bp, Artificial Sequence
  dgRNA
  Scrt1
agcgcgcccgggcgc

SEQ ID NO: 64466 - DNA, 15 bp, Artificial Sequence
  dgRNA
  Scrt1
cccgggcgctggccg

SEQ ID NO: 64467 - DNA, 15 bp, Artificial Sequence
  dgRNA
  Scrt1
tgccctagccagcgc

SEQ ID NO: 64468 - DNA, 15 bp, Artificial Sequence
  dgRNA
  Olfr406
tgtatcataaccatc

SEQ ID NO: 64469 - DNA, 15 bp, Artificial Sequence
  dgRNA
  Mecp2
cacaggctggtcggg

SEQ ID NO: 64470 - DNA, 15 bp, Artificial Sequence
  dgRNA
  Mecp2
acaggctggtcggga

SEQ ID NO: 64471 - DNA, 15 bp, Artificial Sequence
  dgRNA
  Mecp2
gctggtcgggagggc

SEQ ID NO: 64472 - DNA, 15 bp, Artificial Sequence
  dgRNA
  Mecp2
ctggtcgggagggcg

SEQ ID NO: 64473 - DNA, 15 bp, Artificial Sequence
  dgRNA
  Lce1f
gcatgccttgacatc

SEQ ID NO: 64474 - DNA, 15 bp, Artificial Sequence
  dgRNA
  Lce1f
gccttgacatcaggg

SEQ ID NO: 64475 - DNA, 15 bp, Artificial Sequence
  dgRNA
  Lce1f
tagccattatctcac

SEQ ID NO: 64476 - DNA, 15 bp, Artificial Sequence
  dgRNA
  Ece1
tcgggcccgcacccc

SEQ ID NO: 64477 - DNA, 15 bp, Artificial Sequence
  dgRNA
  Ece1
ggacccaccggtatc

SEQ ID NO: 64478 - DNA, 15 bp, Artificial Sequence
  dgRNA
  Ece1
gacccaccggtatcc

SEQ ID NO: 64479 - DNA, 15 bp, Artificial Sequence
  dgRNA
  Ece1
acccaccggtatccg

SEQ ID NO: 64480 - DNA, 15 bp, Artificial Sequence
  dgRNA
  Gtf2e2
acgcaggcgcctttt

SEQ ID NO: 64481 - DNA, 15 bp, Artificial Sequence
  dgRNA
  Gtf2e2
ggcgccttttcggag

SEQ ID NO: 64482 - DNA, 15 bp, Artificial Sequence
  dgRNA
  Gtf2e2
ttcggagcggcgtcg

SEQ ID NO: 64483 - DNA, 15 bp, Artificial Sequence
  dgRNA
  Gtf2e2
ggagcggcgtcgcgg

SEQ ID NO: 64484 - DNA, 15 bp, Artificial Sequence
  dgRNA
  Stx18
acagttcccaggcgg

SEQ ID NO: 64485 - DNA, 15 bp, Artificial Sequence
  dgRNA
  Stx18
ggaggagtgcgaaat

SEQ ID NO: 64486 - DNA, 15 bp, Artificial Sequence
  dgRNA
  Stx18
cgcactcctccgcct

SEQ ID NO: 64487 - DNA, 15 bp, Artificial Sequence
  dgRNA
  Stx18
tcgcactcctccgcc

SEQ ID NO: 64488 - DNA, 15 bp, Artificial Sequence
  dgRNA
  Purb
ggcggagtgacgtca

SEQ ID NO: 64489 - DNA, 15 bp, Artificial Sequence
  dgRNA
  Purb
gcggagtgacgtcac

SEQ ID NO: 64490 - DNA, 15 bp, Artificial Sequence
  dgRNA
  Purb
gagtgacgtcacggg

SEQ ID NO: 64491 - DNA, 15 bp, Artificial Sequence
  dgRNA
  Purb
acgggaggcgcgcgc

SEQ ID NO: 64492 - DNA, 15 bp, Artificial Sequence
  dgRNA
  Gpha2
ctgtgcggaggcttc

SEQ ID NO: 64493 - DNA, 15 bp, Artificial Sequence
  dgRNA
  Gpha2
cggaggcttcaggct

SEQ ID NO: 64494 - DNA, 15 bp, Artificial Sequence
  dgRNA
  Gpha2
ctgaaatctgatatc

SEQ ID NO: 64495 - DNA, 15 bp, Artificial Sequence
  dgRNA
  Gpha2
atatctgggagggcg

SEQ ID NO: 64496 - DNA, 15 bp, Artificial Sequence
  dgRNA
  Hrh1
cttactaatagtgag

SEQ ID NO: 64497 - DNA, 15 bp, Artificial Sequence
  dgRNA
  Hrh1
tgcctagcgcagaaa

SEQ ID NO: 64498 - DNA, 15 bp, Artificial Sequence
  dgRNA
  Hrh1
cgcagaaacggaaag

SEQ ID NO: 64499 - DNA, 15 bp, Artificial Sequence
  dgRNA
  Hrh1
ggtgtctgccaacgc

SEQ ID NO: 64500 - DNA, 15 bp, Artificial Sequence
  dgRNA
  Cdc27
caacccaacagtttc

SEQ ID NO: 64501 - DNA, 15 bp, Artificial Sequence
  dgRNA
  Cdc27
gtttccggtagcact

SEQ ID NO: 64502 - DNA, 15 bp, Artificial Sequence
  dgRNA
  Cdc27
gcactcggtaatttc

SEQ ID NO: 64503 - DNA, 15 bp, Artificial Sequence
  dgRNA
  Cdc27
gtaatttccggccac

SEQ ID NO: 64504 - DNA, 15 bp, Artificial Sequence
  dgRNA
  Pum3
ctcagacgagaggtg

SEQ ID NO: 64505 - DNA, 15 bp, Artificial Sequence
  dgRNA
  Pum3
gaggtgtggcgaaaa

SEQ ID NO: 64506 - DNA, 15 bp, Artificial Sequence
  dgRNA
  Pum3
cgaaaatggaccaac

SEQ ID NO: 64507 - DNA, 15 bp, Artificial Sequence
  dgRNA
  Pum3
taacgctacaatcag

SEQ ID NO: 64508 - DNA, 15 bp, Artificial Sequence
  dgRNA
  Fgd4
gccaatgggcgacgc

SEQ ID NO: 64509 - DNA, 15 bp, Artificial Sequence
  dgRNA
  Fgd4
agcctcttcggcgct

SEQ ID NO: 64510 - DNA, 15 bp, Artificial Sequence
  dgRNA
  Fgd4
gcctcttcggcgctc

SEQ ID NO: 64511 - DNA, 15 bp, Artificial Sequence
  dgRNA
  Fgd4
tcttcggcgctcggg

SEQ ID NO: 64512 - DNA, 15 bp, Artificial Sequence
  dgRNA
  Marf1
actggaggaagcgac

SEQ ID NO: 64513 - DNA, 15 bp, Artificial Sequence
  dgRNA
  Marf1
ctggaggaagcgact

SEQ ID NO: 64514 - DNA, 15 bp, Artificial Sequence
  dgRNA
  Marf1
agcgactgggcggag

SEQ ID NO: 64515 - DNA, 15 bp, Artificial Sequence
  dgRNA
  Marf1
gcgactgggcggagt

SEQ ID NO: 64516 - DNA, 15 bp, Artificial Sequence
  dgRNA
  Hal
ctcaacgcgtgtttg

SEQ ID NO: 64517 - DNA, 15 bp, Artificial Sequence
  dgRNA
  Hal
gggattgctacactc

SEQ ID NO: 64518 - DNA, 15 bp, Artificial Sequence
  dgRNA
  Hal
ggattgctacactct

SEQ ID NO: 64519 - DNA, 15 bp, Artificial Sequence
  dgRNA
  Hal
tcacaattgaccgag

SEQ ID NO: 64520 - DNA, 15 bp, Artificial Sequence
  dgRNA
  Frrs1
agtcaagtgttgtga

SEQ ID NO: 64521 - DNA, 15 bp, Artificial Sequence
  dgRNA
  Frrs1
gtcaagtgttgtgaa

SEQ ID NO: 64522 - DNA, 15 bp, Artificial Sequence
  dgRNA
  Frrs1
aattagagttctccc

SEQ ID NO: 64523 - DNA, 15 bp, Artificial Sequence
  dgRNA
  Frrs1
tcctaatccaccttc

SEQ ID NO: 64524 - DNA, 15 bp, Artificial Sequence
  dgRNA
  Olfr996
ttgctcagatctaat

SEQ ID NO: 64525 - DNA, 15 bp, Artificial Sequence
  dgRNA
  Dnajb2
cccctgtcctgtcgc

SEQ ID NO: 64526 - DNA, 15 bp, Artificial Sequence
  dgRNA
  Ngly1
ctgtgcaattatctc

SEQ ID NO: 64527 - DNA, 15 bp, Artificial Sequence
  dgRNA
  Ngly1
cgagatctactccac

SEQ ID NO: 64528 - DNA, 15 bp, Artificial Sequence
  dgRNA
  Ngly1
cccaacgttcgcaac

SEQ ID NO: 64529 - DNA, 15 bp, Artificial Sequence
  dgRNA
  Ngly1
caaccggcctctccg

SEQ ID NO: 64530 - DNA, 15 bp, Artificial Sequence
  dgRNA
  Pih1h3b
gtcgacctacttagc

SEQ ID NO: 64531 - DNA, 15 bp, Artificial Sequence
  dgRNA
  Pih1h3b
ggaaaagggcggccg

SEQ ID NO: 64532 - DNA, 15 bp, Artificial Sequence
  dgRNA
  Pih1h3b
aaagggcggccgtgg

SEQ ID NO: 64533 - DNA, 15 bp, Artificial Sequence
  dgRNA
  Pih1h3b
gggattccccgggat

SEQ ID NO: 64534 - DNA, 15 bp, Artificial Sequence
  dgRNA
  Ass1
cccaggcgccaccag

SEQ ID NO: 64535 - DNA, 15 bp, Artificial Sequence
  dgRNA
  Ass1
ccaggcgccaccagc

SEQ ID NO: 64536 - DNA, 15 bp, Artificial Sequence
  dgRNA
  Ass1
cgccaccagcgggtc

SEQ ID NO: 64537 - DNA, 15 bp, Artificial Sequence
  dgRNA
  Ass1
cagcgggtcaggatc

SEQ ID NO: 64538 - DNA, 15 bp, Artificial Sequence
  dgRNA
  Pitpnc1
tccccattggccgga

SEQ ID NO: 64539 - DNA, 15 bp, Artificial Sequence
  dgRNA
  Pitpnc1
ccccattggccggat

SEQ ID NO: 64540 - DNA, 15 bp, Artificial Sequence
  dgRNA
  Pitpnc1
cccattggccggatg

SEQ ID NO: 64541 - DNA, 15 bp, Artificial Sequence
  dgRNA
  Pitpnc1
ctaccctccccgccg

SEQ ID NO: 64542 - DNA, 15 bp, Artificial Sequence
  dgRNA
  Gm364
gtggtacattaatgc

SEQ ID NO: 64543 - DNA, 15 bp, Artificial Sequence
  dgRNA
  Gm364
ggtgtcctagcaacg

SEQ ID NO: 64544 - DNA, 15 bp, Artificial Sequence
  dgRNA
  Gm364
ctccaacggttcttc

SEQ ID NO: 64545 - DNA, 15 bp, Artificial Sequence
  dgRNA
  Gm364
accgtgcctggaaac

SEQ ID NO: 64546 - DNA, 15 bp, Artificial Sequence
  dgRNA
  Dpysl2
cccgggctcacagaa

SEQ ID NO: 64547 - DNA, 15 bp, Artificial Sequence
  dgRNA
  Dpysl2
cagaaagggcgcgaa

SEQ ID NO: 64548 - DNA, 15 bp, Artificial Sequence
  dgRNA
  Dpysl2
ggcgcgctcccagct

SEQ ID NO: 64549 - DNA, 15 bp, Artificial Sequence
  dgRNA
  Dpysl2
gcgcgctcccagctc

SEQ ID NO: 64550 - DNA, 15 bp, Artificial Sequence
  dgRNA
  Srbd1
gcccctggaccgcac

SEQ ID NO: 64551 - DNA, 15 bp, Artificial Sequence
  dgRNA
  Srbd1
cccgccccggtagtg

SEQ ID NO: 64552 - DNA, 15 bp, Artificial Sequence
  dgRNA
  Srbd1
ggctccagtaaagta

SEQ ID NO: 64553 - DNA, 15 bp, Artificial Sequence
  dgRNA
  Srbd1
tccagtaaagtaagg

SEQ ID NO: 64554 - DNA, 15 bp, Artificial Sequence
  dgRNA
  Dnah10
cctgacagcagacta

SEQ ID NO: 64555 - DNA, 15 bp, Artificial Sequence
  dgRNA
  Dnah10
ccctcagccccgcgc

SEQ ID NO: 64556 - DNA, 15 bp, Artificial Sequence
  dgRNA
  Dnah10
ctggcgccgttgccc

SEQ ID NO: 64557 - DNA, 15 bp, Artificial Sequence
  dgRNA
  Dnah10
aacctacacttagca

SEQ ID NO: 64558 - DNA, 15 bp, Artificial Sequence
  dgRNA
  Vmn1r215
atgatgactgcaatc

SEQ ID NO: 64559 - DNA, 15 bp, Artificial Sequence
  dgRNA
  Adap2
cgactgaataaacca

SEQ ID NO: 64560 - DNA, 15 bp, Artificial Sequence
  dgRNA
  Adap2
aggctagattagatc

SEQ ID NO: 64561 - DNA, 15 bp, Artificial Sequence
  dgRNA
  Adap2
gtccctccccttagg

SEQ ID NO: 64562 - DNA, 15 bp, Artificial Sequence
  dgRNA
  Adap2
ttaggcggtggagct

SEQ ID NO: 64563 - DNA, 15 bp, Artificial Sequence
  dgRNA
  Ddx58
tgcgccccaacttaa

SEQ ID NO: 64564 - DNA, 15 bp, Artificial Sequence
  dgRNA
  Ddx58
ttccaaggtacttct

SEQ ID NO: 64565 - DNA, 15 bp, Artificial Sequence
  dgRNA
  Ddx58
gtccttgcggttcag

SEQ ID NO: 64566 - DNA, 15 bp, Artificial Sequence
  dgRNA
  Ddx58
gttcagaaacgaaac

SEQ ID NO: 64567 - DNA, 15 bp, Artificial Sequence
  dgRNA
  Il11ra1
gaacgcagcagtttc

SEQ ID NO: 64568 - DNA, 15 bp, Artificial Sequence
  dgRNA
  Il11ra1
cctctaagttccaga

SEQ ID NO: 64569 - DNA, 15 bp, Artificial Sequence
  dgRNA
  Il11ra1
agttccagacgggac

SEQ ID NO: 64570 - DNA, 15 bp, Artificial Sequence
  dgRNA
  Il11ra1
gttggaggctccaat

SEQ ID NO: 64571 - DNA, 15 bp, Artificial Sequence
  dgRNA
  Dsg1c
acatctaaatgaccc

SEQ ID NO: 64572 - DNA, 15 bp, Artificial Sequence
  dgRNA
  Dsg1c
catctaaatgacccg

SEQ ID NO: 64573 - DNA, 15 bp, Artificial Sequence
  dgRNA
  Dsg1c
tgacccggggattag

SEQ ID NO: 64574 - DNA, 15 bp, Artificial Sequence
  dgRNA
  Dsg1c
gacccggggattagt

SEQ ID NO: 64575 - DNA, 15 bp, Artificial Sequence
  dgRNA
  Kcnmb4
aggttgcatctggcg

SEQ ID NO: 64576 - DNA, 15 bp, Artificial Sequence
  dgRNA
  Kcnmb4
tccgagagcagctcg

SEQ ID NO: 64577 - DNA, 15 bp, Artificial Sequence
  dgRNA
  Kcnmb4
gagagcagctcgcgg

SEQ ID NO: 64578 - DNA, 15 bp, Artificial Sequence
  dgRNA
  Kcnmb4
cagctcgcggcggcc

SEQ ID NO: 64579 - DNA, 15 bp, Artificial Sequence
  dgRNA
  Vmn1r59
gttcgtttgaaaagc

SEQ ID NO: 64580 - DNA, 15 bp, Artificial Sequence
  dgRNA
  Mavs
cccccttcatctgcg

SEQ ID NO: 64581 - DNA, 15 bp, Artificial Sequence
  dgRNA
  Mavs
ccccttcatctgcga

SEQ ID NO: 64582 - DNA, 15 bp, Artificial Sequence
  dgRNA
  Mavs
ctgcacagtcgaacg

SEQ ID NO: 64583 - DNA, 15 bp, Artificial Sequence
  dgRNA
  Mavs
cgcagatgaaggggg

SEQ ID NO: 64584 - DNA, 15 bp, Artificial Sequence
  dgRNA
  Tex35
gcattcctaggctta

SEQ ID NO: 64585 - DNA, 15 bp, Artificial Sequence
  dgRNA
  Tex35
agctagcaacactct

SEQ ID NO: 64586 - DNA, 15 bp, Artificial Sequence
  dgRNA
  Tex35
gttccgcacacaaag

SEQ ID NO: 64587 - DNA, 15 bp, Artificial Sequence
  dgRNA
  Tex35
ccgcacacaaagagg

SEQ ID NO: 64588 - DNA, 15 bp, Artificial Sequence
  dgRNA
  Slitrk2
agcaactgacgcagc

SEQ ID NO: 64589 - DNA, 15 bp, Artificial Sequence
  dgRNA
  Slitrk2
gcaactgacgcagct

SEQ ID NO: 64590 - DNA, 15 bp, Artificial Sequence
  dgRNA
  Slitrk2
ccccaccaagcgccc

SEQ ID NO: 64591 - DNA, 15 bp, Artificial Sequence
  dgRNA
  Slitrk2
cctagtcctgtcccg

SEQ ID NO: 64592 - DNA, 15 bp, Artificial Sequence
  dgRNA
  Zfp663
taaaaaatgcccgat

SEQ ID NO: 64593 - DNA, 15 bp, Artificial Sequence
  dgRNA
  Zfp663
aaaatgcccgatggg

SEQ ID NO: 64594 - DNA, 15 bp, Artificial Sequence
  dgRNA
  Zfp663
aaatgcccgatgggc

SEQ ID NO: 64595 - DNA, 15 bp, Artificial Sequence
  dgRNA
  Zfp663
gatgggcgggcgccg

SEQ ID NO: 64596 - DNA, 15 bp, Artificial Sequence
  dgRNA
  Radil
cctatctttctcggt

SEQ ID NO: 64597 - DNA, 15 bp, Artificial Sequence
  dgRNA
  Radil
ctttctcggtcggcc

SEQ ID NO: 64598 - DNA, 15 bp, Artificial Sequence
  dgRNA
  Radil
gaccccgcccactcg

SEQ ID NO: 64599 - DNA, 15 bp, Artificial Sequence
  dgRNA
  Radil
tccgtctctgcccat

SEQ ID NO: 64600 - DNA, 15 bp, Artificial Sequence
  dgRNA
  Itgbl1
ctctcaagccgccaa

SEQ ID NO: 64601 - DNA, 15 bp, Artificial Sequence
  dgRNA
  Itgbl1
tctcaagccgccaat

SEQ ID NO: 64602 - DNA, 15 bp, Artificial Sequence
  dgRNA
  Itgbl1
ctcaagccgccaatg

SEQ ID NO: 64603 - DNA, 15 bp, Artificial Sequence
  dgRNA
  Itgbl1
taatactgctggtgg

SEQ ID NO: 64604 - DNA, 15 bp, Artificial Sequence
  dgRNA
  Dnah9
accttattaacttag

SEQ ID NO: 64605 - DNA, 15 bp, Artificial Sequence
  dgRNA
  Dnah9
ccttattaacttagt

SEQ ID NO: 64606 - DNA, 15 bp, Artificial Sequence
  dgRNA
  Dnah9
cttattaacttagtg

SEQ ID NO: 64607 - DNA, 15 bp, Artificial Sequence
  dgRNA
  Dnah9
attaacttagtgggg

SEQ ID NO: 64608 - DNA, 15 bp, Artificial Sequence
  dgRNA
  Tomm20
cgtctttcattagca

SEQ ID NO: 64609 - DNA, 15 bp, Artificial Sequence
  dgRNA
  Tomm20
ctcagccgcgcagac

SEQ ID NO: 64610 - DNA, 15 bp, Artificial Sequence
  dgRNA
  Tomm20
tcagccgcgcagact

SEQ ID NO: 64611 - DNA, 15 bp, Artificial Sequence
  dgRNA
  Tomm20
ctgcgcgtgcgcacc

SEQ ID NO: 64612 - DNA, 15 bp, Artificial Sequence
  dgRNA
  Lysmd4
gccaatcggcgggcg

SEQ ID NO: 64613 - DNA, 15 bp, Artificial Sequence
  dgRNA
  Lysmd4
aatcggcgggcgcgg

SEQ ID NO: 64614 - DNA, 15 bp, Artificial Sequence
  dgRNA
  Atl1
gcctccgggcctcgt

SEQ ID NO: 64615 - DNA, 15 bp, Artificial Sequence
  dgRNA
  Atl1
ctcgtcggtcccgcc

SEQ ID NO: 64616 - DNA, 15 bp, Artificial Sequence
  dgRNA
  Atl1
cgccaggccccgcgc

SEQ ID NO: 64617 - DNA, 15 bp, Artificial Sequence
  dgRNA
  Atl1
ccggccgtacccgag

SEQ ID NO: 64618 - DNA, 15 bp, Artificial Sequence
  dgRNA
  Banp
ggggcgcaggccgtg

SEQ ID NO: 64619 - DNA, 15 bp, Artificial Sequence
  dgRNA
  Banp
gcgcaggccgtgggg

SEQ ID NO: 64620 - DNA, 15 bp, Artificial Sequence
  dgRNA
  Banp
gtggggaggcgctcg

SEQ ID NO: 64621 - DNA, 15 bp, Artificial Sequence
  dgRNA
  Banp
gcagccgctctgcgc

SEQ ID NO: 64622 - DNA, 15 bp, Artificial Sequence
  dgRNA
  Pkhd1
ctttgggtctctaag

SEQ ID NO: 64623 - DNA, 15 bp, Artificial Sequence
  dgRNA
  Pkhd1
ggtgcacgtttagcc

SEQ ID NO: 64624 - DNA, 15 bp, Artificial Sequence
  dgRNA
  Dhx32
gaccaaaaagtgacg

SEQ ID NO: 64625 - DNA, 15 bp, Artificial Sequence
  dgRNA
  Dhx32
cgcagagcagcgcac

SEQ ID NO: 64626 - DNA, 15 bp, Artificial Sequence
  dgRNA
  Dhx32
agagcagcgcacggg

SEQ ID NO: 64627 - DNA, 15 bp, Artificial Sequence
  dgRNA
  Dhx32
gagcagcgcacgggc

SEQ ID NO: 64628 - DNA, 15 bp, Artificial Sequence
  dgRNA
  Kctd12
cgggagcgagctcag

SEQ ID NO: 64629 - DNA, 15 bp, Artificial Sequence
  dgRNA
  Kctd12
gccgcgccgcccaag

SEQ ID NO: 64630 - DNA, 15 bp, Artificial Sequence
  dgRNA
  Kctd12
ccgcgccgcccaagc

SEQ ID NO: 64631 - DNA, 15 bp, Artificial Sequence
  dgRNA
  Kctd12
cgccgcccaagcggg

SEQ ID NO: 64632 - DNA, 15 bp, Artificial Sequence
  dgRNA
  1810009A15Rik
gtccccgccaagaaa

SEQ ID NO: 64633 - DNA, 15 bp, Artificial Sequence
  dgRNA
  1810009A15Rik
cgtgaaaaccaccct

SEQ ID NO: 64634 - DNA, 15 bp, Artificial Sequence
  dgRNA
  1810009A15Rik
aggccccgcaacgcg

SEQ ID NO: 64635 - DNA, 15 bp, Artificial Sequence
  dgRNA
  1810009A15Rik
cctccaagctgcgat

SEQ ID NO: 64636 - DNA, 15 bp, Artificial Sequence
  dgRNA
  BC005624
ggccgtcctgttgag

SEQ ID NO: 64637 - DNA, 15 bp, Artificial Sequence
  dgRNA
  BC005624
agcatggttactcga

SEQ ID NO: 64638 - DNA, 15 bp, Artificial Sequence
  dgRNA
  BC005624
gcatggttactcgat

SEQ ID NO: 64639 - DNA, 15 bp, Artificial Sequence
  dgRNA
  BC005624
gttactcgatgggcg

SEQ ID NO: 64640 - DNA, 15 bp, Artificial Sequence
  dgRNA
  Ammecr1
cgtggcgcgcgccgc

SEQ ID NO: 64641 - DNA, 15 bp, Artificial Sequence
  dgRNA
  Ammecr1
ggcgcgcgccgcagg

SEQ ID NO: 64642 - DNA, 15 bp, Artificial Sequence
  dgRNA
  Ammecr1
gcgcgcgccgcaggc

SEQ ID NO: 64643 - DNA, 15 bp, Artificial Sequence
  dgRNA
  Ammecr1
cgcgcgccgcaggcg

SEQ ID NO: 64644 - DNA, 15 bp, Artificial Sequence
  dgRNA
  Tmem128
ctcatcccagactag

SEQ ID NO: 64645 - DNA, 15 bp, Artificial Sequence
  dgRNA
  Tmem128
atcccagactagcgg

SEQ ID NO: 64646 - DNA, 15 bp, Artificial Sequence
  dgRNA
  Tmem128
gaacccctacagagc

SEQ ID NO: 64647 - DNA, 15 bp, Artificial Sequence
  dgRNA
  Tmem128
gagtaaccgggagac

SEQ ID NO: 64648 - DNA, 15 bp, Artificial Sequence
  dgRNA
  Casp6
gacgcagtggcgtcc

SEQ ID NO: 64649 - DNA, 15 bp, Artificial Sequence
  dgRNA
  Casp6
cgtcctggcgttgcc

SEQ ID NO: 64650 - DNA, 15 bp, Artificial Sequence
  dgRNA
  Casp6
gtcctggcgttgcct

SEQ ID NO: 64651 - DNA, 15 bp, Artificial Sequence
  dgRNA
  Casp6
gggcccagttgcttg

SEQ ID NO: 64652 - DNA, 15 bp, Artificial Sequence
  dgRNA
  Arl6
cggctcccaatgcag

SEQ ID NO: 64653 - DNA, 15 bp, Artificial Sequence
  dgRNA
  Arl6
tcctctgcgggaatc

SEQ ID NO: 64654 - DNA, 15 bp, Artificial Sequence
  dgRNA
  Arl6
gacacctacgacgcc

SEQ ID NO: 64655 - DNA, 15 bp, Artificial Sequence
  dgRNA
  Arl6
acacctacgacgccc

SEQ ID NO: 64656 - DNA, 15 bp, Artificial Sequence
  dgRNA
  Jade1
gtgttcaaaagtatc

SEQ ID NO: 64657 - DNA, 15 bp, Artificial Sequence
  dgRNA
  Jade1
gtatccggaagcagt

SEQ ID NO: 64658 - DNA, 15 bp, Artificial Sequence
  dgRNA
  Jade1
tccggaagcagtcgg

SEQ ID NO: 64659 - DNA, 15 bp, Artificial Sequence
  dgRNA
  Jade1
aggcgccagccgggc

SEQ ID NO: 64660 - DNA, 15 bp, Artificial Sequence
  dgRNA
  Lmtk3
agtgagccccccgcg

SEQ ID NO: 64661 - DNA, 15 bp, Artificial Sequence
  dgRNA
  Lmtk3
ggtccagcctcattg

SEQ ID NO: 64662 - DNA, 15 bp, Artificial Sequence
  dgRNA
  Lmtk3
gtccagcctcattga

SEQ ID NO: 64663 - DNA, 15 bp, Artificial Sequence
  dgRNA
  Lmtk3
gaggggacgagtcgc

SEQ ID NO: 64664 - DNA, 15 bp, Artificial Sequence
  dgRNA
  Ace
ggccctaagcagaaa

SEQ ID NO: 64665 - DNA, 15 bp, Artificial Sequence
  dgRNA
  Ace
cttattggccggtga

SEQ ID NO: 64666 - DNA, 15 bp, Artificial Sequence
  dgRNA
  Ace
ttattggccggtgat

SEQ ID NO: 64667 - DNA, 15 bp, Artificial Sequence
  dgRNA
  Ace
accccaagggccctc

SEQ ID NO: 64668 - DNA, 15 bp, Artificial Sequence
  dgRNA
  Vmn1r1
aagtacatgtactgc

SEQ ID NO: 64669 - DNA, 15 bp, Artificial Sequence
  dgRNA
  Dgke
gccccgccctacacc

SEQ ID NO: 64670 - DNA, 15 bp, Artificial Sequence
  dgRNA
  Dgke
ggaaagcaccgccat

SEQ ID NO: 64671 - DNA, 15 bp, Artificial Sequence
  dgRNA
  Dgke
tggctttgtcctacc

SEQ ID NO: 64672 - DNA, 15 bp, Artificial Sequence
  dgRNA
  Dgke
gccccgcccaagttg

SEQ ID NO: 64673 - DNA, 15 bp, Artificial Sequence
  dgRNA
  Spp2
agataaacattatac

SEQ ID NO: 64674 - DNA, 15 bp, Artificial Sequence
  dgRNA
  Spp2
taaagtccctcggag

SEQ ID NO: 64675 - DNA, 15 bp, Artificial Sequence
  dgRNA
  Spp2
gtggactcaacaaaa

SEQ ID NO: 64676 - DNA, 15 bp, Artificial Sequence
  dgRNA
  Spp2
actttatcccacagc

SEQ ID NO: 64677 - DNA, 15 bp, Artificial Sequence
  dgRNA
  Adtrp
caaggaaccccggca

SEQ ID NO: 64678 - DNA, 15 bp, Artificial Sequence
  dgRNA
  Adtrp
cggcaaggtcaagcc

SEQ ID NO: 64679 - DNA, 15 bp, Artificial Sequence
  dgRNA
  Adtrp
gcttggcctcgggcc

SEQ ID NO: 64680 - DNA, 15 bp, Artificial Sequence
  dgRNA
  Adtrp
ggttgggtgagttca

SEQ ID NO: 64681 - DNA, 15 bp, Artificial Sequence
  dgRNA
  Rfwd2
caagcccgaccgcct

SEQ ID NO: 64682 - DNA, 15 bp, Artificial Sequence
  dgRNA
  Rfwd2
ccgcctcggcgcgcc

SEQ ID NO: 64683 - DNA, 15 bp, Artificial Sequence
  dgRNA
  Rfwd2
cgcctcggcgcgccc

SEQ ID NO: 64684 - DNA, 15 bp, Artificial Sequence
  dgRNA
  Rfwd2
tcggcgcgcccgggt

SEQ ID NO: 64685 - DNA, 15 bp, Artificial Sequence
  dgRNA
  Pou3f4
cttgtagtctccggg

SEQ ID NO: 64686 - DNA, 15 bp, Artificial Sequence
  dgRNA
  Pou3f4
ttgtagtctccggga

SEQ ID NO: 64687 - DNA, 15 bp, Artificial Sequence
  dgRNA
  Pou3f4
tgtagtctccgggag

SEQ ID NO: 64688 - DNA, 15 bp, Artificial Sequence
  dgRNA
  Pou3f4
gtagtctccgggagg

SEQ ID NO: 64689 - DNA, 15 bp, Artificial Sequence
  dgRNA
  Rasd2
aaaccttcgagcacc

SEQ ID NO: 64690 - DNA, 15 bp, Artificial Sequence
  dgRNA
  Rasd2
agcacctggctcaac

SEQ ID NO: 64691 - DNA, 15 bp, Artificial Sequence
  dgRNA
  Rasd2
cggagtcccccctgt

SEQ ID NO: 64692 - DNA, 15 bp, Artificial Sequence
  dgRNA
  Rasd2
ggagtcccccctgtc

SEQ ID NO: 64693 - DNA, 15 bp, Artificial Sequence
  dgRNA
  Bmp8a
cccccgtgatcccat

SEQ ID NO: 64694 - DNA, 15 bp, Artificial Sequence
  dgRNA
  Bmp8a
cgtgatcccattggc

SEQ ID NO: 64695 - DNA, 15 bp, Artificial Sequence
  dgRNA
  Bmp8a
cccattggctggtcg

SEQ ID NO: 64696 - DNA, 15 bp, Artificial Sequence
  dgRNA
  Bmp8a
ttggctggtcgggga

SEQ ID NO: 64697 - DNA, 15 bp, Artificial Sequence
  dgRNA
  Olfr824
cctagagctaatgca

SEQ ID NO: 64698 - DNA, 15 bp, Artificial Sequence
  dgRNA
  Olfr824
agtgaggcacgtgag

SEQ ID NO: 64699 - DNA, 15 bp, Artificial Sequence
  dgRNA
  Olfr824
ccatgcattagctct

SEQ ID NO: 64700 - DNA, 15 bp, Artificial Sequence
  dgRNA
  Olfr824
tgtggctcctattca

SEQ ID NO: 64701 - DNA, 15 bp, Artificial Sequence
  dgRNA
  Camk4
ttcgagcctcgctcc

SEQ ID NO: 64702 - DNA, 15 bp, Artificial Sequence
  dgRNA
  Camk4
gcgccaacaatgacc

SEQ ID NO: 64703 - DNA, 15 bp, Artificial Sequence
  dgRNA
  Camk4
ttctcaccacgcact

SEQ ID NO: 64704 - DNA, 15 bp, Artificial Sequence
  dgRNA
  Camk4
ggtactttccactcc

SEQ ID NO: 64705 - DNA, 15 bp, Artificial Sequence
  dgRNA
  Zfp707
gaccacccatatcaa

SEQ ID NO: 64706 - DNA, 15 bp, Artificial Sequence
  dgRNA
  Zfp707
acccatatcaacgga

SEQ ID NO: 64707 - DNA, 15 bp, Artificial Sequence
  dgRNA
  Zfp707
cccatatcaacggaa

SEQ ID NO: 64708 - DNA, 15 bp, Artificial Sequence
  dgRNA
  Zfp707
tatcaacggaagggc

SEQ ID NO: 64709 - DNA, 15 bp, Artificial Sequence
  dgRNA
  Caps2
tttgtctgctagtgt

SEQ ID NO: 64710 - DNA, 15 bp, Artificial Sequence
  dgRNA
  Caps2
ttgtctgctagtgta

SEQ ID NO: 64711 - DNA, 15 bp, Artificial Sequence
  dgRNA
  Caps2
ttgtccagactgtag

SEQ ID NO: 64712 - DNA, 15 bp, Artificial Sequence
  dgRNA
  Caps2
attagagtacagatt

SEQ ID NO: 64713 - DNA, 15 bp, Artificial Sequence
  dgRNA
  Fastkd3
ccgccgaatacctcc

SEQ ID NO: 64714 - DNA, 15 bp, Artificial Sequence
  dgRNA
  Fastkd3
gcgcgaattcccgcg

SEQ ID NO: 64715 - DNA, 15 bp, Artificial Sequence
  dgRNA
  Fastkd3
ccgttctcctccgac

SEQ ID NO: 64716 - DNA, 15 bp, Artificial Sequence
  dgRNA
  Fastkd3
ccgacaggcacagtc

SEQ ID NO: 64717 - DNA, 15 bp, Artificial Sequence
  dgRNA
  Srsf12
gcctgctctcccgtc

SEQ ID NO: 64718 - DNA, 15 bp, Artificial Sequence
  dgRNA
  Srsf12
cctgctctcccgtct

SEQ ID NO: 64719 - DNA, 15 bp, Artificial Sequence
  dgRNA
  Srsf12
ctgtttattgcctcg

SEQ ID NO: 64720 - DNA, 15 bp, Artificial Sequence
  dgRNA
  Srsf12
gctccacatcaggct

SEQ ID NO: 64721 - DNA, 15 bp, Artificial Sequence
  dgRNA
  Olfr1198
catatgttctcacga

SEQ ID NO: 64722 - DNA, 15 bp, Artificial Sequence
  dgRNA
  Olfr1198
gttgtaacaagtaaa

SEQ ID NO: 64723 - DNA, 15 bp, Artificial Sequence
  dgRNA
  Olfr1198
tccatctaaataatt

SEQ ID NO: 64724 - DNA, 15 bp, Artificial Sequence
  dgRNA
  Olfr1198
gcctaattatttaga

SEQ ID NO: 64725 - DNA, 15 bp, Artificial Sequence
  dgRNA
  Atad5
gcgcagattcgccaa

SEQ ID NO: 64726 - DNA, 15 bp, Artificial Sequence
  dgRNA
  Atad5
gtagtttgtccttcg

SEQ ID NO: 64727 - DNA, 15 bp, Artificial Sequence
  dgRNA
  Atad5
cgcagcctccgacag

SEQ ID NO: 64728 - DNA, 15 bp, Artificial Sequence
  dgRNA
  Atad5
tacctaatcatttgg

SEQ ID NO: 64729 - DNA, 15 bp, Artificial Sequence
  dgRNA
  E2f4
ccatacaattttttc

SEQ ID NO: 64730 - DNA, 15 bp, Artificial Sequence
  dgRNA
  E2f4
cctaaggagttgttt

SEQ ID NO: 64731 - DNA, 15 bp, Artificial Sequence
  dgRNA
  E2f4
tgatacatttgccga

SEQ ID NO: 64732 - DNA, 15 bp, Artificial Sequence
  dgRNA
  E2f4
ttgccgacggtcccc

SEQ ID NO: 64733 - DNA, 15 bp, Artificial Sequence
  dgRNA
  Rnf10
aagaaggaacccgct

SEQ ID NO: 64734 - DNA, 15 bp, Artificial Sequence
  dgRNA
  Rnf10
agaaggaacccgcta

SEQ ID NO: 64735 - DNA, 15 bp, Artificial Sequence
  dgRNA
  Rnf10
aggaacccgctaggg

SEQ ID NO: 64736 - DNA, 15 bp, Artificial Sequence
  dgRNA
  Rnf10
aacccgctagggagg

SEQ ID NO: 64737 - DNA, 15 bp, Artificial Sequence
  dgRNA
  Ccsap
tggcggagaaggatc

SEQ ID NO: 64738 - DNA, 15 bp, Artificial Sequence
  dgRNA
  Tas1r2
catgcaggccccact

SEQ ID NO: 64739 - DNA, 15 bp, Artificial Sequence
  dgRNA
  Tas1r2
atgtccgctcatccc

SEQ ID NO: 64740 - DNA, 15 bp, Artificial Sequence
  dgRNA
  Tas1r2
tgtccgctcatcccc

SEQ ID NO: 64741 - DNA, 15 bp, Artificial Sequence
  dgRNA
  Tas1r2
cgctcatccccgggc

SEQ ID NO: 64742 - DNA, 15 bp, Artificial Sequence
  dgRNA
  Lkaaear1
ccttaatgcttgcat

SEQ ID NO: 64743 - DNA, 15 bp, Artificial Sequence
  dgRNA
  Lkaaear1
tgcattggggcttat

SEQ ID NO: 64744 - DNA, 15 bp, Artificial Sequence
  dgRNA
  Lkaaear1
gcattggggcttatt

SEQ ID NO: 64745 - DNA, 15 bp, Artificial Sequence
  dgRNA
  Lkaaear1
cattggggcttattg

SEQ ID NO: 64746 - DNA, 15 bp, Artificial Sequence
  dgRNA
  Pcdha6
gatcgtttactatca

SEQ ID NO: 64747 - DNA, 15 bp, Artificial Sequence
  dgRNA
  Pcdha6
tttactatcaaggta

SEQ ID NO: 64748 - DNA, 15 bp, Artificial Sequence
  dgRNA
  Pcdha6
tcgcttcttaccttt

SEQ ID NO: 64749 - DNA, 15 bp, Artificial Sequence
  dgRNA
  Pcdha6
ccttttggagccgct

SEQ ID NO: 64750 - DNA, 15 bp, Artificial Sequence
  dgRNA
  Alpk2
cagtgacaactcctc

SEQ ID NO: 64751 - DNA, 15 bp, Artificial Sequence
  dgRNA
  Alpk2
ggcctctccagcggc

SEQ ID NO: 64752 - DNA, 15 bp, Artificial Sequence
  dgRNA
  Alpk2
ggagttgtcactgac

SEQ ID NO: 64753 - DNA, 15 bp, Artificial Sequence
  dgRNA
  Alpk2
ccgctggagaggccc

SEQ ID NO: 64754 - DNA, 15 bp, Artificial Sequence
  dgRNA
  Vmn1r67
tgttacagtacataa

SEQ ID NO: 64755 - DNA, 15 bp, Artificial Sequence
  dgRNA
  Vmn1r67
gggtccttaaagctc

SEQ ID NO: 64756 - DNA, 15 bp, Artificial Sequence
  dgRNA
  Vmn1r67
gaggctaaatcagag

SEQ ID NO: 64757 - DNA, 15 bp, Artificial Sequence
  dgRNA
  Vmn1r67
ctgaggctaaatcag

SEQ ID NO: 64758 - DNA, 15 bp, Artificial Sequence
  dgRNA
  Mtch2
ttgcctttgccgtca

SEQ ID NO: 64759 - DNA, 15 bp, Artificial Sequence
  dgRNA
  Mtch2
cagcggactaacaac

SEQ ID NO: 64760 - DNA, 15 bp, Artificial Sequence
  dgRNA
  Rcan3
taagagtgccggccc

SEQ ID NO: 64761 - DNA, 15 bp, Artificial Sequence
  dgRNA
  Rcan3
gagtgccggcccagg

SEQ ID NO: 64762 - DNA, 15 bp, Artificial Sequence
  dgRNA
  Rcan3
agtgccggcccaggg

SEQ ID NO: 64763 - DNA, 15 bp, Artificial Sequence
  dgRNA
  Rcan3
gtgccggcccagggg

SEQ ID NO: 64764 - DNA, 15 bp, Artificial Sequence
  dgRNA
  4930415O20Rik
atacctcaagcttcc

SEQ ID NO: 64765 - DNA, 15 bp, Artificial Sequence
  dgRNA
  4930415O20Rik
aatcctgtgctctac

SEQ ID NO: 64766 - DNA, 15 bp, Artificial Sequence
  dgRNA
  4930415O20Rik
tgctctactggacaa

SEQ ID NO: 64767 - DNA, 15 bp, Artificial Sequence
  dgRNA
  4930415O20Rik
aggaactgccagtta

SEQ ID NO: 64768 - DNA, 15 bp, Artificial Sequence
  dgRNA
  Galnt18
cagctgtgtccggac

SEQ ID NO: 64769 - DNA, 15 bp, Artificial Sequence
  dgRNA
  Galnt18
gagccagagcgcgat

SEQ ID NO: 64770 - DNA, 15 bp, Artificial Sequence
  dgRNA
  Galnt18
ccagagcgcgattgg

SEQ ID NO: 64771 - DNA, 15 bp, Artificial Sequence
  dgRNA
  Galnt18
gagcgcgattggtgg

SEQ ID NO: 64772 - DNA, 15 bp, Artificial Sequence
  dgRNA
  Bloc1s6
acattcacacggtta

SEQ ID NO: 64773 - DNA, 15 bp, Artificial Sequence
  dgRNA
  Bloc1s6
ggttatggcgacatc

SEQ ID NO: 64774 - DNA, 15 bp, Artificial Sequence
  dgRNA
  Bloc1s6
tcttccgggttccgc

SEQ ID NO: 64775 - DNA, 15 bp, Artificial Sequence
  dgRNA
  Bloc1s6
gaacccgcacgcgca

SEQ ID NO: 64776 - DNA, 15 bp, Artificial Sequence
  dgRNA
  Hsd17b7
gcccccgccgcagac

SEQ ID NO: 64777 - DNA, 15 bp, Artificial Sequence
  dgRNA
  Hsd17b7
cccccgccgcagact

SEQ ID NO: 64778 - DNA, 15 bp, Artificial Sequence
  dgRNA
  Hsd17b7
ccccgccgcagactg

SEQ ID NO: 64779 - DNA, 15 bp, Artificial Sequence
  dgRNA
  Hsd17b7
cccgccgcagactgg

SEQ ID NO: 64780 - DNA, 15 bp, Artificial Sequence
  dgRNA
  Ncam2
aaagcccgggactcc

SEQ ID NO: 64781 - DNA, 15 bp, Artificial Sequence
  dgRNA
  Ncam2
ctgggctcgaacccg

SEQ ID NO: 64782 - DNA, 15 bp, Artificial Sequence
  dgRNA
  Ncam2
gctcgaacccgtggc

SEQ ID NO: 64783 - DNA, 15 bp, Artificial Sequence
  dgRNA
  Ncam2
ctcgaacccgtggct

SEQ ID NO: 64784 - DNA, 15 bp, Artificial Sequence
  dgRNA
  Fibcd1
tcaccccccagcgac

SEQ ID NO: 64785 - DNA, 15 bp, Artificial Sequence
  dgRNA
  Fibcd1
caccccccagcgacc

SEQ ID NO: 64786 - DNA, 15 bp, Artificial Sequence
  dgRNA
  Fibcd1
gcgaccgggctagag

SEQ ID NO: 64787 - DNA, 15 bp, Artificial Sequence
  dgRNA
  Fibcd1
cgaccgggctagagc

SEQ ID NO: 64788 - DNA, 15 bp, Artificial Sequence
  dgRNA
  Slamf9
gatttctacgggatc

SEQ ID NO: 64789 - DNA, 15 bp, Artificial Sequence
  dgRNA
  Slamf9
atttctacgggatct

SEQ ID NO: 64790 - DNA, 15 bp, Artificial Sequence
  dgRNA
  Slamf9
gtcaaagtctgtatt

SEQ ID NO: 64791 - DNA, 15 bp, Artificial Sequence
  dgRNA
  Slamf9
catctgactgttaga

SEQ ID NO: 64792 - DNA, 15 bp, Artificial Sequence
  dgRNA
  Cd24a
catcccaagtcaccc

SEQ ID NO: 64793 - DNA, 15 bp, Artificial Sequence
  dgRNA
  Cd24a
caagtcaccccgggc

SEQ ID NO: 64794 - DNA, 15 bp, Artificial Sequence
  dgRNA
  Cd24a
accccgggccggtgc

SEQ ID NO: 64795 - DNA, 15 bp, Artificial Sequence
  dgRNA
  Cd24a
ccgggccggtgcagg

SEQ ID NO: 64796 - DNA, 15 bp, Artificial Sequence
  dgRNA
  Aym1
gactggagtgctcaa

SEQ ID NO: 64797 - DNA, 15 bp, Artificial Sequence
  dgRNA
  Aym1
gagggaatctcccta

SEQ ID NO: 64798 - DNA, 15 bp, Artificial Sequence
  dgRNA
  Aym1
agggaatctccctaa

SEQ ID NO: 64799 - DNA, 15 bp, Artificial Sequence
  dgRNA
  Aym1
gtgtgcccggcagag

SEQ ID NO: 64800 - DNA, 15 bp, Artificial Sequence
  dgRNA
  Lrrc15
cgagtccgaaggaga

SEQ ID NO: 64801 - DNA, 15 bp, Artificial Sequence
  dgRNA
  Lrrc15
gagtccgaaggagat

SEQ ID NO: 64802 - DNA, 15 bp, Artificial Sequence
  dgRNA
  Lrrc15
agtccgaaggagatg

SEQ ID NO: 64803 - DNA, 15 bp, Artificial Sequence
  dgRNA
  Lrrc15
gttgccccgccccgc

SEQ ID NO: 64804 - DNA, 15 bp, Artificial Sequence
  dgRNA
  Hoxd1
cgctctcccccgagc

SEQ ID NO: 64805 - DNA, 15 bp, Artificial Sequence
  dgRNA
  Hoxd1
gctctcccccgagct

SEQ ID NO: 64806 - DNA, 15 bp, Artificial Sequence
  dgRNA
  Hoxd1
ctcccccgagctggg

SEQ ID NO: 64807 - DNA, 15 bp, Artificial Sequence
  dgRNA
  Hoxd1
ccccgagctgggcgg

SEQ ID NO: 64808 - DNA, 15 bp, Artificial Sequence
  dgRNA
  Hyal2
aatccccattccagg

SEQ ID NO: 64809 - DNA, 15 bp, Artificial Sequence
  dgRNA
  Hyal2
tctacagaagatcta

SEQ ID NO: 64810 - DNA, 15 bp, Artificial Sequence
  dgRNA
  Hyal2
ctcgaaacgcagcac

SEQ ID NO: 64811 - DNA, 15 bp, Artificial Sequence
  dgRNA
  Hyal2
gcagcactggcaaaa

SEQ ID NO: 64812 - DNA, 15 bp, Artificial Sequence
  dgRNA
  Nell2
taggatcccgagcgg

SEQ ID NO: 64813 - DNA, 15 bp, Artificial Sequence
  dgRNA
  Nell2
cccgagcggaggctg

SEQ ID NO: 64814 - DNA, 15 bp, Artificial Sequence
  dgRNA
  Nell2
cggaggctgcggttg

SEQ ID NO: 64815 - DNA, 15 bp, Artificial Sequence
  dgRNA
  Nell2
ggttgcgggcttgcg

SEQ ID NO: 64816 - DNA, 15 bp, Artificial Sequence
  dgRNA
  Bdp1
gcgttgcagttgcta

SEQ ID NO: 64817 - DNA, 15 bp, Artificial Sequence
  dgRNA
  Bdp1
atggctcccggcgcc

SEQ ID NO: 64818 - DNA, 15 bp, Artificial Sequence
  dgRNA
  Bdp1
gtctgacgtcatcgt

SEQ ID NO: 64819 - DNA, 15 bp, Artificial Sequence
  dgRNA
  Bdp1
attacgcattgcttc

SEQ ID NO: 64820 - DNA, 15 bp, Artificial Sequence
  dgRNA
  Lipg
ctagtttctccctgc

SEQ ID NO: 64821 - DNA, 15 bp, Artificial Sequence
  dgRNA
  Lipg
ctgcaggcgtccacg

SEQ ID NO: 64822 - DNA, 15 bp, Artificial Sequence
  dgRNA
  Lipg
caggcgtccacgcgg

SEQ ID NO: 64823 - DNA, 15 bp, Artificial Sequence
  dgRNA
  Lipg
aggcgtccacgcggt

SEQ ID NO: 64824 - DNA, 15 bp, Artificial Sequence
  dgRNA
  Man1a
gggcgagtcttaaca

SEQ ID NO: 64825 - DNA, 15 bp, Artificial Sequence
  dgRNA
  Man1a
tcttaacacggctcc

SEQ ID NO: 64826 - DNA, 15 bp, Artificial Sequence
  dgRNA
  Man1a
cttaacacggctccc

SEQ ID NO: 64827 - DNA, 15 bp, Artificial Sequence
  dgRNA
  Man1a
cgcagttccagtcct

SEQ ID NO: 64828 - DNA, 15 bp, Artificial Sequence
  dgRNA
  Hist1h2ag
ttgatgacgtcatat

SEQ ID NO: 64829 - DNA, 15 bp, Artificial Sequence
  dgRNA
  Hist1h2ag
acgtcatataggctt

SEQ ID NO: 64830 - DNA, 15 bp, Artificial Sequence
  dgRNA
  Hist1h2ag
ataatcgctttccat

SEQ ID NO: 64831 - DNA, 15 bp, Artificial Sequence
  dgRNA
  Hist1h2ag
aggaacgttcgggat

SEQ ID NO: 64832 - DNA, 15 bp, Artificial Sequence
  dgRNA
  Ly75
cgcagaggtctgcct

SEQ ID NO: 64833 - DNA, 15 bp, Artificial Sequence
  dgRNA
  Ly75
aggtctgccttgggt

SEQ ID NO: 64834 - DNA, 15 bp, Artificial Sequence
  dgRNA
  Ly75
ctgcaaagcctccgc

SEQ ID NO: 64835 - DNA, 15 bp, Artificial Sequence
  dgRNA
  Ly75
tgcaaagcctccgct

SEQ ID NO: 64836 - DNA, 15 bp, Artificial Sequence
  dgRNA
  Col26a1
ccctgggggtacccc

SEQ ID NO: 64837 - DNA, 15 bp, Artificial Sequence
  dgRNA
  Col26a1
ggggtacccccggct

SEQ ID NO: 64838 - DNA, 15 bp, Artificial Sequence
  dgRNA
  Col26a1
agtcctggaccgctg

SEQ ID NO: 64839 - DNA, 15 bp, Artificial Sequence
  dgRNA
  Col26a1
gtcctggaccgctga

SEQ ID NO: 64840 - DNA, 15 bp, Artificial Sequence
  dgRNA
  Add3
gatgcccgtttaaag

SEQ ID NO: 64841 - DNA, 15 bp, Artificial Sequence
  dgRNA
  Add3
atgcccgtttaaagt

SEQ ID NO: 64842 - DNA, 15 bp, Artificial Sequence
  dgRNA
  Add3
accactaaatatcct

SEQ ID NO: 64843 - DNA, 15 bp, Artificial Sequence
  dgRNA
  Add3
ttgactttgctagag

SEQ ID NO: 64844 - DNA, 15 bp, Artificial Sequence
  dgRNA
  Ank3
attgggtcctgcaag

SEQ ID NO: 64845 - DNA, 15 bp, Artificial Sequence
  dgRNA
  Ank3
gtccttaatccaatc

SEQ ID NO: 64846 - DNA, 15 bp, Artificial Sequence
  dgRNA
  Ank3
cttaatccaatcagg

SEQ ID NO: 64847 - DNA, 15 bp, Artificial Sequence
  dgRNA
  Ank3
atttttcgcatgttt

SEQ ID NO: 64848 - DNA, 15 bp, Artificial Sequence
  dgRNA
  Ddhd2
catctcgcgacactt

SEQ ID NO: 64849 - DNA, 15 bp, Artificial Sequence
  dgRNA
  Ddhd2
ctcgcgacacttcgg

SEQ ID NO: 64850 - DNA, 15 bp, Artificial Sequence
  dgRNA
  Ddhd2
atctttctgcgcctc

SEQ ID NO: 64851 - DNA, 15 bp, Artificial Sequence
  dgRNA
  Ddhd2
gcctccggctctcac

SEQ ID NO: 64852 - DNA, 15 bp, Artificial Sequence
  dgRNA
  Slc14a2
gcttggccaaattca

SEQ ID NO: 64853 - DNA, 15 bp, Artificial Sequence
  dgRNA
  Slc14a2
actacttgtccctcc

SEQ ID NO: 64854 - DNA, 15 bp, Artificial Sequence
  dgRNA
  Slc14a2
gcatggcacctaacc

SEQ ID NO: 64855 - DNA, 15 bp, Artificial Sequence
  dgRNA
  Slc14a2
gttagacacacgagg

SEQ ID NO: 64856 - DNA, 15 bp, Artificial Sequence
  dgRNA
  Plekhg4
acttcctcctaaccg

SEQ ID NO: 64857 - DNA, 15 bp, Artificial Sequence
  dgRNA
  Plekhg4
gacccactcttacca

SEQ ID NO: 64858 - DNA, 15 bp, Artificial Sequence
  dgRNA
  Plekhg4
taaagtagtccagcc

SEQ ID NO: 64859 - DNA, 15 bp, Artificial Sequence
  dgRNA
  Plekhg4
gctaggctgggtacc

SEQ ID NO: 64860 - DNA, 15 bp, Artificial Sequence
  dgRNA
  Tmem151b
gcttctcccctttag

SEQ ID NO: 64861 - DNA, 15 bp, Artificial Sequence
  dgRNA
  Tmem151b
tcccctttagcggtg

SEQ ID NO: 64862 - DNA, 15 bp, Artificial Sequence
  dgRNA
  Tmem151b
cctttagcggtgtgg

SEQ ID NO: 64863 - DNA, 15 bp, Artificial Sequence
  dgRNA
  Tmem151b
gttattaggaaggct

SEQ ID NO: 64864 - DNA, 15 bp, Artificial Sequence
  dgRNA
  Rasgrp3
gacttatcagctctt

SEQ ID NO: 64865 - DNA, 15 bp, Artificial Sequence
  dgRNA
  Rasgrp3
aagtaaaacaaacgg

SEQ ID NO: 64866 - DNA, 15 bp, Artificial Sequence
  dgRNA
  Rasgrp3
gccaacccacggctc

SEQ ID NO: 64867 - DNA, 15 bp, Artificial Sequence
  dgRNA
  Rasgrp3
tcacaccgggagggc

SEQ ID NO: 64868 - DNA, 15 bp, Artificial Sequence
  dgRNA
  Txndc15
gtgtcgcaagcagcg

SEQ ID NO: 64869 - DNA, 15 bp, Artificial Sequence
  dgRNA
  Txndc15
agcgaggagttctca

SEQ ID NO: 64870 - DNA, 15 bp, Artificial Sequence
  dgRNA
  Txndc15
gcgaggagttctcat

SEQ ID NO: 64871 - DNA, 15 bp, Artificial Sequence
  dgRNA
  Txndc15
agcggcttccagtac

SEQ ID NO: 64872 - DNA, 15 bp, Artificial Sequence
  dgRNA
  Mtmr12
ctcgctagccaatcg

SEQ ID NO: 64873 - DNA, 15 bp, Artificial Sequence
  dgRNA
  Mtmr12
tcgctagccaatcgt

SEQ ID NO: 64874 - DNA, 15 bp, Artificial Sequence
  dgRNA
  Mtmr12
cgctagccaatcgtg

SEQ ID NO: 64875 - DNA, 15 bp, Artificial Sequence
  dgRNA
  Mtmr12
aatcgtggggaagcc

SEQ ID NO: 64876 - DNA, 15 bp, Artificial Sequence
  dgRNA
  4932429P05Rik
aatagatactgttaa

SEQ ID NO: 64877 - DNA, 15 bp, Artificial Sequence
  dgRNA
  Cacna1c
cgttcactactaaag

SEQ ID NO: 64878 - DNA, 15 bp, Artificial Sequence
  dgRNA
  Cacna1c
cttggctctgatacg

SEQ ID NO: 64879 - DNA, 15 bp, Artificial Sequence
  dgRNA
  Cacna1c
tcagaaatgccccgc

SEQ ID NO: 64880 - DNA, 15 bp, Artificial Sequence
  dgRNA
  Cacna1c
gttcagttctaccag

SEQ ID NO: 64881 - DNA, 15 bp, Artificial Sequence
  dgRNA
  Pmvk
gagcctccccgcgtc

SEQ ID NO: 64882 - DNA, 15 bp, Artificial Sequence
  dgRNA
  Pmvk
gacttcgtgaccgag

SEQ ID NO: 64883 - DNA, 15 bp, Artificial Sequence
  dgRNA
  Pmvk
agagcaggtgtccgc

SEQ ID NO: 64884 - DNA, 15 bp, Artificial Sequence
  dgRNA
  Pmvk
ggtgtccgcgggtgc

SEQ ID NO: 64885 - DNA, 15 bp, Artificial Sequence
  dgRNA
  Gm973
ttagccagtgaatca

SEQ ID NO: 64886 - DNA, 15 bp, Artificial Sequence
  dgRNA
  Gm973
tagccagtgaatcac

SEQ ID NO: 64887 - DNA, 15 bp, Artificial Sequence
  dgRNA
  Gm973
gaatcacgggaactc

SEQ ID NO: 64888 - DNA, 15 bp, Artificial Sequence
  dgRNA
  Gm973
aatcacgggaactca

SEQ ID NO: 64889 - DNA, 15 bp, Artificial Sequence
  dgRNA
  Primpol
cacgccagtcgcgat

SEQ ID NO: 64890 - DNA, 15 bp, Artificial Sequence
  dgRNA
  Primpol
gccagtcgcgattgg

SEQ ID NO: 64891 - DNA, 15 bp, Artificial Sequence
  dgRNA
  Primpol
cccgtctcgtagcgc

SEQ ID NO: 64892 - DNA, 15 bp, Artificial Sequence
  dgRNA
  Primpol
ctccgccccctcgcg

SEQ ID NO: 64893 - DNA, 15 bp, Artificial Sequence
  dgRNA
  Krt31
gaattttatgggacc

SEQ ID NO: 64894 - DNA, 15 bp, Artificial Sequence
  dgRNA
  Krt31
aattttatgggacca

SEQ ID NO: 64895 - DNA, 15 bp, Artificial Sequence
  dgRNA
  Krt31
tataaagtctcacca

SEQ ID NO: 64896 - DNA, 15 bp, Artificial Sequence
  dgRNA
  Krt31
ataagccttctacag

SEQ ID NO: 64897 - DNA, 15 bp, Artificial Sequence
  dgRNA
  Fam160a1
agcagctgatcacgc

SEQ ID NO: 64898 - DNA, 15 bp, Artificial Sequence
  dgRNA
  Fam160a1
gcagctgatcacgca

SEQ ID NO: 64899 - DNA, 15 bp, Artificial Sequence
  dgRNA
  Fam160a1
cagctgatcacgcag

SEQ ID NO: 64900 - DNA, 15 bp, Artificial Sequence
  dgRNA
  Fam160a1
gtgatcagctgctgt

SEQ ID NO: 64901 - DNA, 15 bp, Artificial Sequence
  dgRNA
  Fxyd5
gtgtattgtcgtctg

SEQ ID NO: 64902 - DNA, 15 bp, Artificial Sequence
  dgRNA
  Fxyd5
tgtattgtcgtctgt

SEQ ID NO: 64903 - DNA, 15 bp, Artificial Sequence
  dgRNA
  Mbnl1
aggccctcataatct

SEQ ID NO: 64904 - DNA, 15 bp, Artificial Sequence
  dgRNA
  Mbnl1
gtggcaaatacatag

SEQ ID NO: 64905 - DNA, 15 bp, Artificial Sequence
  dgRNA
  Dclk2
ttcttttgcctagcg

SEQ ID NO: 64906 - DNA, 15 bp, Artificial Sequence
  dgRNA
  Dclk2
tagcccccgcgcttg

SEQ ID NO: 64907 - DNA, 15 bp, Artificial Sequence
  dgRNA
  Dclk2
gtggagcgcgcagcg

SEQ ID NO: 64908 - DNA, 15 bp, Artificial Sequence
  dgRNA
  Dclk2
cagcgcggtcacgcc

SEQ ID NO: 64909 - DNA, 15 bp, Artificial Sequence
  dgRNA
  Gm10767
ccacgatacccacaa

SEQ ID NO: 64910 - DNA, 15 bp, Artificial Sequence
  dgRNA
  Gm10767
cgatacccacaaagg

SEQ ID NO: 64911 - DNA, 15 bp, Artificial Sequence
  dgRNA
  Gm10767
ctgggtaagtcctag

SEQ ID NO: 64912 - DNA, 15 bp, Artificial Sequence
  dgRNA
  Gm10767
tcctagaggacacgc

SEQ ID NO: 64913 - DNA, 15 bp, Artificial Sequence
  dgRNA
  Ankef1
ctgtttaggagtacc

SEQ ID NO: 64914 - DNA, 15 bp, Artificial Sequence
  dgRNA
  Ankef1
taggagtacccgggt

SEQ ID NO: 64915 - DNA, 15 bp, Artificial Sequence
  dgRNA
  Ankef1
gctaagcctccgctg

SEQ ID NO: 64916 - DNA, 15 bp, Artificial Sequence
  dgRNA
  Ankef1
gctgcggccccgcga

SEQ ID NO: 64917 - DNA, 15 bp, Artificial Sequence
  dgRNA
  Ccp110
gaccgcagtgcactt

SEQ ID NO: 64918 - DNA, 15 bp, Artificial Sequence
  dgRNA
  Ccp110
accgcagtgcacttt

SEQ ID NO: 64919 - DNA, 15 bp, Artificial Sequence
  dgRNA
  Ccp110
gggaattgtagtcta

SEQ ID NO: 64920 - DNA, 15 bp, Artificial Sequence
  dgRNA
  Ccp110
aattgtagtctatgg

SEQ ID NO: 64921 - DNA, 15 bp, Artificial Sequence
  dgRNA
  Sprr2b
gatgtatcaaacagt

SEQ ID NO: 64922 - DNA, 15 bp, Artificial Sequence
  dgRNA
  Sprr2b
ctgtccagccagtta

SEQ ID NO: 64923 - DNA, 15 bp, Artificial Sequence
  dgRNA
  Sprr2b
atggctatcattact

SEQ ID NO: 64924 - DNA, 15 bp, Artificial Sequence
  dgRNA
  Sprr2b
cgtaactggctggac

SEQ ID NO: 64925 - DNA, 15 bp, Artificial Sequence
  dgRNA
  1700017B05Rik
ccagaggccgggtcg

SEQ ID NO: 64926 - DNA, 15 bp, Artificial Sequence
  dgRNA
  1700017B05Rik
cagaggccgggtcgc

SEQ ID NO: 64927 - DNA, 15 bp, Artificial Sequence
  dgRNA
  1700017B05Rik
gggtcgcgggaaagt

SEQ ID NO: 64928 - DNA, 15 bp, Artificial Sequence
  dgRNA
  1700017B05Rik
aagttggttccactc

SEQ ID NO: 64929 - DNA, 15 bp, Artificial Sequence
  dgRNA
  Hoxa13
tgggtgactgctgcg

SEQ ID NO: 64930 - DNA, 15 bp, Artificial Sequence
  dgRNA
  Hoxa13
tgctgcgcggccgcg

SEQ ID NO: 64931 - DNA, 15 bp, Artificial Sequence
  dgRNA
  Hoxa13
gcgcagaggaccgcg

SEQ ID NO: 64932 - DNA, 15 bp, Artificial Sequence
  dgRNA
  Hoxa13
cgcagaggaccgcgc

SEQ ID NO: 64933 - DNA, 15 bp, Artificial Sequence
  dgRNA
  Lmcd1
ggattcctgccgcct

SEQ ID NO: 64934 - DNA, 15 bp, Artificial Sequence
  dgRNA
  Lmcd1
gattcctgccgccta

SEQ ID NO: 64935 - DNA, 15 bp, Artificial Sequence
  dgRNA
  Lmcd1
attcctgccgcctag

SEQ ID NO: 64936 - DNA, 15 bp, Artificial Sequence
  dgRNA
  Lmcd1
gctgtgagcccgagg

SEQ ID NO: 64937 - DNA, 15 bp, Artificial Sequence
  dgRNA
  Trmt10b
tatgtaaggtttacg

SEQ ID NO: 64938 - DNA, 15 bp, Artificial Sequence
  dgRNA
  Trmt10b
aggtttacgaggact

SEQ ID NO: 64939 - DNA, 15 bp, Artificial Sequence
  dgRNA
  Trmt10b
gcccagccaatctac

SEQ ID NO: 64940 - DNA, 15 bp, Artificial Sequence
  dgRNA
  Trmt10b
caaacaggtgactag

SEQ ID NO: 64941 - DNA, 15 bp, Artificial Sequence
  dgRNA
  Camk1g
gtgtaaacagctact

SEQ ID NO: 64942 - DNA, 15 bp, Artificial Sequence
  dgRNA
  Camk1g
ctactcgggcattaa

SEQ ID NO: 64943 - DNA, 15 bp, Artificial Sequence
  dgRNA
  Camk1g
tactcgggcattaaa

SEQ ID NO: 64944 - DNA, 15 bp, Artificial Sequence
  dgRNA
  Camk1g
ttttaattccctagg

SEQ ID NO: 64945 - DNA, 15 bp, Artificial Sequence
  dgRNA
  Smgc
gtggttggcgtaagc

SEQ ID NO: 64946 - DNA, 15 bp, Artificial Sequence
  dgRNA
  Smgc
ggcgtaagctggact

SEQ ID NO: 64947 - DNA, 15 bp, Artificial Sequence
  dgRNA
  Smgc
tggcctataaatacg

SEQ ID NO: 64948 - DNA, 15 bp, Artificial Sequence
  dgRNA
  Smgc
ggcctataaatacgc

SEQ ID NO: 64949 - DNA, 15 bp, Artificial Sequence
  dgRNA
  Mfrp
ctgtgggttgtggcg

SEQ ID NO: 64950 - DNA, 15 bp, Artificial Sequence
  dgRNA
  Nalcn
aagggtgttcgtaca

SEQ ID NO: 64951 - DNA, 15 bp, Artificial Sequence
  dgRNA
  Nalcn
tagatagaggctaaa

SEQ ID NO: 64952 - DNA, 15 bp, Artificial Sequence
  dgRNA
  Recql4
cgaatcccagccccg

SEQ ID NO: 64953 - DNA, 15 bp, Artificial Sequence
  dgRNA
  Recql4
cctccccgactacca

SEQ ID NO: 64954 - DNA, 15 bp, Artificial Sequence
  dgRNA
  Recql4
agctccgcgcagcgc

SEQ ID NO: 64955 - DNA, 15 bp, Artificial Sequence
  dgRNA
  Recql4
gctccgcgcagcgcc

SEQ ID NO: 64956 - DNA, 15 bp, Artificial Sequence
  dgRNA
  Tmprss12
ccggaaatcctctgc

SEQ ID NO: 64957 - DNA, 15 bp, Artificial Sequence
  dgRNA
  Tmprss12
cggaaatcctctgct

SEQ ID NO: 64958 - DNA, 15 bp, Artificial Sequence
  dgRNA
  Tmprss12
cttccggctgagcaa

SEQ ID NO: 64959 - DNA, 15 bp, Artificial Sequence
  dgRNA
  Tmprss12
ccggctgagcaaagg

SEQ ID NO: 64960 - DNA, 15 bp, Artificial Sequence
  dgRNA
  Bbox1
acaaaggtcccggca

SEQ ID NO: 64961 - DNA, 15 bp, Artificial Sequence
  dgRNA
  Bbox1
caaaggtcccggcat

SEQ ID NO: 64962 - DNA, 15 bp, Artificial Sequence
  dgRNA
  Bbox1
aaaggtcccggcatg

SEQ ID NO: 64963 - DNA, 15 bp, Artificial Sequence
  dgRNA
  Bbox1
catggggcgaactgt

SEQ ID NO: 64964 - DNA, 15 bp, Artificial Sequence
  dgRNA
  Usp27x
gtgaaagtccctttt

SEQ ID NO: 64965 - DNA, 15 bp, Artificial Sequence
  dgRNA
  Usp27x
cgcgctccctcagtc

SEQ ID NO: 64966 - DNA, 15 bp, Artificial Sequence
  dgRNA
  Usp27x
ctccctcagtccgga

SEQ ID NO: 64967 - DNA, 15 bp, Artificial Sequence
  dgRNA
  Usp27x
tccctcagtccggac

SEQ ID NO: 64968 - DNA, 15 bp, Artificial Sequence
  dgRNA
  Pof1b
gactactttacctac

SEQ ID NO: 64969 - DNA, 15 bp, Artificial Sequence
  dgRNA
  Pof1b
actactttacctact

SEQ ID NO: 64970 - DNA, 15 bp, Artificial Sequence
  dgRNA
  Pof1b
gcacgcaaacctgcc

SEQ ID NO: 64971 - DNA, 15 bp, Artificial Sequence
  dgRNA
  Pof1b
gtgaatccgcccctc

SEQ ID NO: 64972 - DNA, 15 bp, Artificial Sequence
  dgRNA
  Slc33a1
gcaatgttatcacca

SEQ ID NO: 64973 - DNA, 15 bp, Artificial Sequence
  dgRNA
  Slc33a1
aaacccgcgctcacg

SEQ ID NO: 64974 - DNA, 15 bp, Artificial Sequence
  dgRNA
  Slc33a1
gctcacgtggcgacg

SEQ ID NO: 64975 - DNA, 15 bp, Artificial Sequence
  dgRNA
  Slc33a1
ctcacgtggcgacga

SEQ ID NO: 64976 - DNA, 15 bp, Artificial Sequence
  dgRNA
  Vmn1r76
gagtaacgtttttgc

SEQ ID NO: 64977 - DNA, 15 bp, Artificial Sequence
  dgRNA
  Abcb8
gtagcaggatcacat

SEQ ID NO: 64978 - DNA, 15 bp, Artificial Sequence
  dgRNA
  Abcb8
tagcaggatcacata

SEQ ID NO: 64979 - DNA, 15 bp, Artificial Sequence
  dgRNA
  Abcb8
ggtggtttcgtgaga

SEQ ID NO: 64980 - DNA, 15 bp, Artificial Sequence
  dgRNA
  Prss52
ctagccattgtgtcc

SEQ ID NO: 64981 - DNA, 15 bp, Artificial Sequence
  dgRNA
  Prss52
gccacctgctgctta

SEQ ID NO: 64982 - DNA, 15 bp, Artificial Sequence
  dgRNA
  Prss52
tagggtggcccaccc

SEQ ID NO: 64983 - DNA, 15 bp, Artificial Sequence
  dgRNA
  Prss52
gtttgtagatgcccc

SEQ ID NO: 64984 - DNA, 15 bp, Artificial Sequence
  dgRNA
  Skint3
agtatattacaagtg

SEQ ID NO: 64985 - DNA, 15 bp, Artificial Sequence
  dgRNA
  Skint3
gtatattacaagtgt

SEQ ID NO: 64986 - DNA, 15 bp, Artificial Sequence
  dgRNA
  Skint3
agtgtgggtcagatt

SEQ ID NO: 64987 - DNA, 15 bp, Artificial Sequence
  dgRNA
  Skint3
gacttgacttatcca

SEQ ID NO: 64988 - DNA, 15 bp, Artificial Sequence
  dgRNA
  A830080D01Rik
gcactttagtctctc

SEQ ID NO: 64989 - DNA, 15 bp, Artificial Sequence
  dgRNA
  A830080D01Rik
gcgctagagagcccg

SEQ ID NO: 64990 - DNA, 15 bp, Artificial Sequence
  dgRNA
  A830080D01Rik
cgctagagagcccgc

SEQ ID NO: 64991 - DNA, 15 bp, Artificial Sequence
  dgRNA
  A830080D01Rik
cccgcgggcgccgtc

SEQ ID NO: 64992 - DNA, 15 bp, Artificial Sequence
  dgRNA
  Tmsb15l
aagatgtgtccaatc

SEQ ID NO: 64993 - DNA, 15 bp, Artificial Sequence
  dgRNA
  Tmsb15l
cagggacgcctgtgt

SEQ ID NO: 64994 - DNA, 15 bp, Artificial Sequence
  dgRNA
  Tmsb15l
agggacgcctgtgta

SEQ ID NO: 64995 - DNA, 15 bp, Artificial Sequence
  dgRNA
  Tmsb15l
tgattggacacatct

SEQ ID NO: 64996 - DNA, 15 bp, Artificial Sequence
  dgRNA
  Prr9
tgtaggctgattaac

SEQ ID NO: 64997 - DNA, 15 bp, Artificial Sequence
  dgRNA
  Prr9
aaacgaagcttgtta

SEQ ID NO: 64998 - DNA, 15 bp, Artificial Sequence
  dgRNA
  Prr9
cgactttagcccacg

SEQ ID NO: 64999 - DNA, 15 bp, Artificial Sequence
  dgRNA
  Prr9
ctacattttggcctc

SEQ ID NO: 65000 - DNA, 15 bp, Artificial Sequence
  dgRNA
  Ndufa7
tcgcgagaccgcacg

SEQ ID NO: 65001 - DNA, 15 bp, Artificial Sequence
  dgRNA
  Ndufa7
ccgcacgcggtaccc

SEQ ID NO: 65002 - DNA, 15 bp, Artificial Sequence
  dgRNA
  Ndufa7
gggtgaggcgactgc

SEQ ID NO: 65003 - DNA, 15 bp, Artificial Sequence
  dgRNA
  Ndufa7
agagccgactataaa

SEQ ID NO: 65004 - DNA, 15 bp, Artificial Sequence
  dgRNA
  Zfp961
tccggactatgttga

SEQ ID NO: 65005 - DNA, 15 bp, Artificial Sequence
  dgRNA
  Zfp961
tatgttgaaggcgat

SEQ ID NO: 65006 - DNA, 15 bp, Artificial Sequence
  dgRNA
  Zfp961
ccgtccaatcagcag

SEQ ID NO: 65007 - DNA, 15 bp, Artificial Sequence
  dgRNA
  Zfp961
cgtccaatcagcagc

SEQ ID NO: 65008 - DNA, 15 bp, Artificial Sequence
  dgRNA
  Parp3
gctccggcgccagcc

SEQ ID NO: 65009 - DNA, 15 bp, Artificial Sequence
  dgRNA
  Parp3
gcgccagcctggagt

SEQ ID NO: 65010 - DNA, 15 bp, Artificial Sequence
  dgRNA
  Parp3
ctctcttgcgatttc

SEQ ID NO: 65011 - DNA, 15 bp, Artificial Sequence
  dgRNA
  Parp3
tgcgatttccggcct

SEQ ID NO: 65012 - DNA, 15 bp, Artificial Sequence
  dgRNA
  Cebpa
ccccactcaccgcct

SEQ ID NO: 65013 - DNA, 15 bp, Artificial Sequence
  dgRNA
  Cebpa
caggcaccatcctac

SEQ ID NO: 65014 - DNA, 15 bp, Artificial Sequence
  dgRNA
  Cebpa
gatccgagacccgtt

SEQ ID NO: 65015 - DNA, 15 bp, Artificial Sequence
  dgRNA
  Cebpa
acccgtttggacacc

SEQ ID NO: 65016 - DNA, 15 bp, Artificial Sequence
  dgRNA
  Rnf24
tatgaaccttatagc

SEQ ID NO: 65017 - DNA, 15 bp, Artificial Sequence
  dgRNA
  Rnf24
atgaaccttatagct

SEQ ID NO: 65018 - DNA, 15 bp, Artificial Sequence
  dgRNA
  Rnf24
cagtagcccagcgga

SEQ ID NO: 65019 - DNA, 15 bp, Artificial Sequence
  dgRNA
  Rnf24
agtagcccagcggaa

SEQ ID NO: 65020 - DNA, 15 bp, Artificial Sequence
  dgRNA
  Ccdc127
gcaacacgcccctcc

SEQ ID NO: 65021 - DNA, 15 bp, Artificial Sequence
  dgRNA
  Il17d
tcgactgcatccccg

SEQ ID NO: 65022 - DNA, 15 bp, Artificial Sequence
  dgRNA
  Il17d
tccccgaggccccac

SEQ ID NO: 65023 - DNA, 15 bp, Artificial Sequence
  dgRNA
  Il17d
cactggtccgtgccg

SEQ ID NO: 65024 - DNA, 15 bp, Artificial Sequence
  dgRNA
  Il17d
cgtgccgaggcgtcg

SEQ ID NO: 65025 - DNA, 15 bp, Artificial Sequence
  dgRNA
  Usp35
atctggaccgggttg

SEQ ID NO: 65026 - DNA, 15 bp, Artificial Sequence
  dgRNA
  Usp35
tctggaccgggttgt

SEQ ID NO: 65027 - DNA, 15 bp, Artificial Sequence
  dgRNA
  Usp35
gtccccagccccgtg

SEQ ID NO: 65028 - DNA, 15 bp, Artificial Sequence
  dgRNA
  Usp35
aatatcacgttgggg

SEQ ID NO: 65029 - DNA, 15 bp, Artificial Sequence
  dgRNA
  Stxbp4
tccgccctgaccacc

SEQ ID NO: 65030 - DNA, 15 bp, Artificial Sequence
  dgRNA
  Stxbp4
ccgccctgaccaccc

SEQ ID NO: 65031 - DNA, 15 bp, Artificial Sequence
  dgRNA
  Stxbp4
gaaagaatgcccgcc

SEQ ID NO: 65032 - DNA, 15 bp, Artificial Sequence
  dgRNA
  Stxbp4
agaatgcccgcctgg

SEQ ID NO: 65033 - DNA, 15 bp, Artificial Sequence
  dgRNA
  Synpo2l
ggtccatgcagtaaa

SEQ ID NO: 65034 - DNA, 15 bp, Artificial Sequence
  dgRNA
  Synpo2l
gtccatgcagtaaaa

SEQ ID NO: 65035 - DNA, 15 bp, Artificial Sequence
  dgRNA
  Synpo2l
ggagtaacacagttg

SEQ ID NO: 65036 - DNA, 15 bp, Artificial Sequence
  dgRNA
  Synpo2l
gagtaacacagttgg

SEQ ID NO: 65037 - DNA, 15 bp, Artificial Sequence
  dgRNA
  Accs
tcccgccagatcgcc

SEQ ID NO: 65038 - DNA, 15 bp, Artificial Sequence
  dgRNA
  Accs
cccgccagatcgcca

SEQ ID NO: 65039 - DNA, 15 bp, Artificial Sequence
  dgRNA
  Accs
ccgccagatcgccag

SEQ ID NO: 65040 - DNA, 15 bp, Artificial Sequence
  dgRNA
  Accs
cgccagatcgccagg

SEQ ID NO: 65041 - DNA, 15 bp, Artificial Sequence
  dgRNA
  Olfr1111
agaactttacattgc

SEQ ID NO: 65042 - DNA, 15 bp, Artificial Sequence
  dgRNA
  Olfr1111
caatgtaaagttctc

SEQ ID NO: 65043 - DNA, 15 bp, Artificial Sequence
  dgRNA
  Ccar2
gcttacttttctgat

SEQ ID NO: 65044 - DNA, 15 bp, Artificial Sequence
  dgRNA
  Ccar2
ggacaccaccgagct

SEQ ID NO: 65045 - DNA, 15 bp, Artificial Sequence
  dgRNA
  Ccar2
gagctcggcttccga

SEQ ID NO: 65046 - DNA, 15 bp, Artificial Sequence
  dgRNA
  Ccar2
ttccgaaggcattat

SEQ ID NO: 65047 - DNA, 15 bp, Artificial Sequence
  dgRNA
  Tbc1d24
gcaagcgcgtgcttg

SEQ ID NO: 65048 - DNA, 15 bp, Artificial Sequence
  dgRNA
  Tbc1d24
caagcgcgtgcttgt

SEQ ID NO: 65049 - DNA, 15 bp, Artificial Sequence
  dgRNA
  Tbc1d24
aagcgcgtgcttgtg

SEQ ID NO: 65050 - DNA, 15 bp, Artificial Sequence
  dgRNA
  Tbc1d24
cgcgtgcttgtgggg

SEQ ID NO: 65051 - DNA, 15 bp, Artificial Sequence
  dgRNA
  Rnf144b
caagttgcccgcgtc

SEQ ID NO: 65052 - DNA, 15 bp, Artificial Sequence
  dgRNA
  Rnf144b
cgcgtccggatttcc

SEQ ID NO: 65053 - DNA, 15 bp, Artificial Sequence
  dgRNA
  Rnf144b
gctgcctgcttacta

SEQ ID NO: 65054 - DNA, 15 bp, Artificial Sequence
  dgRNA
  Rnf144b
taaggagtgcgcctc

SEQ ID NO: 65055 - DNA, 15 bp, Artificial Sequence
  dgRNA
  Pbx1
caccatcctctaaag

SEQ ID NO: 65056 - DNA, 15 bp, Artificial Sequence
  dgRNA
  Pbx1
ccaggcgccgatccg

SEQ ID NO: 65057 - DNA, 15 bp, Artificial Sequence
  dgRNA
  Pbx1
tctttagaggatggt

SEQ ID NO: 65058 - DNA, 15 bp, Artificial Sequence
  dgRNA
  Pbx1
ctcggatcggcgcct

SEQ ID NO: 65059 - DNA, 15 bp, Artificial Sequence
  dgRNA
  Pim3
aacacgcgtaactcg

SEQ ID NO: 65060 - DNA, 15 bp, Artificial Sequence
  dgRNA
  Pim3
cgtaactcgcggagc

SEQ ID NO: 65061 - DNA, 15 bp, Artificial Sequence
  dgRNA
  Pim3
tgaccttcctcagcg

SEQ ID NO: 65062 - DNA, 15 bp, Artificial Sequence
  dgRNA
  Pim3
ttcctcagcgcggcc

SEQ ID NO: 65063 - DNA, 15 bp, Artificial Sequence
  dgRNA
  Fgf6
ccgagtgcctgaagc

SEQ ID NO: 65064 - DNA, 15 bp, Artificial Sequence
  dgRNA
  Fgf6
cctgccgccatgccg

SEQ ID NO: 65065 - DNA, 15 bp, Artificial Sequence
  dgRNA
  Fgf6
ctgccgccatgccga

SEQ ID NO: 65066 - DNA, 15 bp, Artificial Sequence
  dgRNA
  Fgf6
tgccgccatgccgag

SEQ ID NO: 65067 - DNA, 15 bp, Artificial Sequence
  dgRNA
  Taf7
gagaagacgtagtca

SEQ ID NO: 65068 - DNA, 15 bp, Artificial Sequence
  dgRNA
  Taf7
cgccgctagtacttc

SEQ ID NO: 65069 - DNA, 15 bp, Artificial Sequence
  dgRNA
  Taf7
gtacttccggaagag

SEQ ID NO: 65070 - DNA, 15 bp, Artificial Sequence
  dgRNA
  Taf7
cttccggaagagcgg

SEQ ID NO: 65071 - DNA, 15 bp, Artificial Sequence
  dgRNA
  Spata13
tagcgggtagaggca

SEQ ID NO: 65072 - DNA, 15 bp, Artificial Sequence
  dgRNA
  Spata13
ggctgcgaggacccc

SEQ ID NO: 65073 - DNA, 15 bp, Artificial Sequence
  dgRNA
  Spata13
ccccaggagcgggtt

SEQ ID NO: 65074 - DNA, 15 bp, Artificial Sequence
  dgRNA
  Spata13
cccaggagcgggttc

SEQ ID NO: 65075 - DNA, 15 bp, Artificial Sequence
  dgRNA
  Moxd1
tttcttctacccggc

SEQ ID NO: 65076 - DNA, 15 bp, Artificial Sequence
  dgRNA
  Moxd1
ttcttctacccggct

SEQ ID NO: 65077 - DNA, 15 bp, Artificial Sequence
  dgRNA
  Moxd1
atacacggtggcagc

SEQ ID NO: 65078 - DNA, 15 bp, Artificial Sequence
  dgRNA
  Moxd1
gacccagaaccagcg

SEQ ID NO: 65079 - DNA, 15 bp, Artificial Sequence
  dgRNA
  Adam3
atgcgcagaaagaac

SEQ ID NO: 65080 - DNA, 15 bp, Artificial Sequence
  dgRNA
  Adam3
tgcgcagaaagaact

SEQ ID NO: 65081 - DNA, 15 bp, Artificial Sequence
  dgRNA
  Adam3
ctgggactaggtagc

SEQ ID NO: 65082 - DNA, 15 bp, Artificial Sequence
  dgRNA
  Adam3
agtccagcgttcatg

SEQ ID NO: 65083 - DNA, 15 bp, Artificial Sequence
  dgRNA
  Cbx3
cccgcgcctagtgag

SEQ ID NO: 65084 - DNA, 15 bp, Artificial Sequence
  dgRNA
  Cbx3
gcgcctagtgagagg

SEQ ID NO: 65085 - DNA, 15 bp, Artificial Sequence
  dgRNA
  Cbx3
cgctgtttatctccc

SEQ ID NO: 65086 - DNA, 15 bp, Artificial Sequence
  dgRNA
  Cbx3
ccggccttcaagatc

SEQ ID NO: 65087 - DNA, 15 bp, Artificial Sequence
  dgRNA
  Dgkq
tgcttatacgagcaa

SEQ ID NO: 65088 - DNA, 15 bp, Artificial Sequence
  dgRNA
  Dgkq
atctagtatcctgtg

SEQ ID NO: 65089 - DNA, 15 bp, Artificial Sequence
  dgRNA
  Dgkq
tggagaatctggcgc

SEQ ID NO: 65090 - DNA, 15 bp, Artificial Sequence
  dgRNA
  Dgkq
agaatctggcgctgg

SEQ ID NO: 65091 - DNA, 15 bp, Artificial Sequence
  dgRNA
  Zik1
cagacgcatatctga

SEQ ID NO: 65092 - DNA, 15 bp, Artificial Sequence
  dgRNA
  Zik1
gatagtaccatcttc

SEQ ID NO: 65093 - DNA, 15 bp, Artificial Sequence
  dgRNA
  Zik1
taccatcttcgggtt

SEQ ID NO: 65094 - DNA, 15 bp, Artificial Sequence
  dgRNA
  Zik1
atcttcgggtttggc

SEQ ID NO: 65095 - DNA, 15 bp, Artificial Sequence
  dgRNA
  Ankrd10
gccacgccctatccc

SEQ ID NO: 65096 - DNA, 15 bp, Artificial Sequence
  dgRNA
  Ankrd10
agcaccacctgcggg

SEQ ID NO: 65097 - DNA, 15 bp, Artificial Sequence
  dgRNA
  Ankrd10
ggccccaccctatcc

SEQ ID NO: 65098 - DNA, 15 bp, Artificial Sequence
  dgRNA
  Ankrd10
caccctatccaggcg

SEQ ID NO: 65099 - DNA, 15 bp, Artificial Sequence
  dgRNA
  Ifi202b
caactgtgaataata

SEQ ID NO: 65100 - DNA, 15 bp, Artificial Sequence
  dgRNA
  Ifi202b
aactgtgaataatag

SEQ ID NO: 65101 - DNA, 15 bp, Artificial Sequence
  dgRNA
  Ifi202b
actgtgaataatagg

SEQ ID NO: 65102 - DNA, 15 bp, Artificial Sequence
  dgRNA
  Ccndbp1
tctagatctgcgggg

SEQ ID NO: 65103 - DNA, 15 bp, Artificial Sequence
  dgRNA
  Ccndbp1
ctagatctgcgggga

SEQ ID NO: 65104 - DNA, 15 bp, Artificial Sequence
  dgRNA
  Ccndbp1
caggccgggccagcg

SEQ ID NO: 65105 - DNA, 15 bp, Artificial Sequence
  dgRNA
  Ccndbp1
cgggccagcggggag

SEQ ID NO: 65106 - DNA, 15 bp, Artificial Sequence
  dgRNA
  Klhdc4
agtcacgcagcttgc

SEQ ID NO: 65107 - DNA, 15 bp, Artificial Sequence
  dgRNA
  Klhdc4
ggtgtgccagcggag

SEQ ID NO: 65108 - DNA, 15 bp, Artificial Sequence
  dgRNA
  Klhdc4
ggctccctactcacg

SEQ ID NO: 65109 - DNA, 15 bp, Artificial Sequence
  dgRNA
  Klhdc4
tcacgcggcccgaga

SEQ ID NO: 65110 - DNA, 15 bp, Artificial Sequence
  dgRNA
  Ppp1r37
ttggaatcgacccct

SEQ ID NO: 65111 - DNA, 15 bp, Artificial Sequence
  dgRNA
  Ppp1r37
gaatcgaccccttgg

SEQ ID NO: 65112 - DNA, 15 bp, Artificial Sequence
  dgRNA
  Ppp1r37
ggcttaggctcgctc

SEQ ID NO: 65113 - DNA, 15 bp, Artificial Sequence
  dgRNA
  Ppp1r37
ttcatcccgagcctt

SEQ ID NO: 65114 - DNA, 15 bp, Artificial Sequence
  dgRNA
  Oxgr1
gcatgtgagcgcttt

SEQ ID NO: 65115 - DNA, 15 bp, Artificial Sequence
  dgRNA
  Oxgr1
ctagcctgttcgtgt

SEQ ID NO: 65116 - DNA, 15 bp, Artificial Sequence
  dgRNA
  Oxgr1
ggccacacaaagtta

SEQ ID NO: 65117 - DNA, 15 bp, Artificial Sequence
  dgRNA
  Oxgr1
aagttaagggtcatc

SEQ ID NO: 65118 - DNA, 15 bp, Artificial Sequence
  dgRNA
  Rom1
acccttcaccccgcc

SEQ ID NO: 65119 - DNA, 15 bp, Artificial Sequence
  dgRNA
  Rom1
cgccaggctcttgcc

SEQ ID NO: 65120 - DNA, 15 bp, Artificial Sequence
  dgRNA
  Rom1
ctcttgcccggcttc

SEQ ID NO: 65121 - DNA, 15 bp, Artificial Sequence
  dgRNA
  Rom1
cggcttccggcccgc

SEQ ID NO: 65122 - DNA, 15 bp, Artificial Sequence
  dgRNA
  Wdr61
cgaccgtggcgctcg

SEQ ID NO: 65123 - DNA, 15 bp, Artificial Sequence
  dgRNA
  Ppef1
tcagatgaatcctgc

SEQ ID NO: 65124 - DNA, 15 bp, Artificial Sequence
  dgRNA
  Ppef1
taccatgctgttaac

SEQ ID NO: 65125 - DNA, 15 bp, Artificial Sequence
  dgRNA
  Ctif
ccccgctaatgcaag

SEQ ID NO: 65126 - DNA, 15 bp, Artificial Sequence
  dgRNA
  Ctif
aacactactctgtcc

SEQ ID NO: 65127 - DNA, 15 bp, Artificial Sequence
  dgRNA
  Ctif
agggcccgccatcct

SEQ ID NO: 65128 - DNA, 15 bp, Artificial Sequence
  dgRNA
  Ctif
tcaagtctttgcacg

SEQ ID NO: 65129 - DNA, 15 bp, Artificial Sequence
  dgRNA
  Lactb
ggattagtagccaga

SEQ ID NO: 65130 - DNA, 15 bp, Artificial Sequence
  dgRNA
  Lactb
gctagaaaggagacg

SEQ ID NO: 65131 - DNA, 15 bp, Artificial Sequence
  dgRNA
  Lactb
aaggagacgaggacc

SEQ ID NO: 65132 - DNA, 15 bp, Artificial Sequence
  dgRNA
  Lactb
cgtcgctcacccacc

SEQ ID NO: 65133 - DNA, 15 bp, Artificial Sequence
  dgRNA
  Zkscan8
tccggaagtggctgt

SEQ ID NO: 65134 - DNA, 15 bp, Artificial Sequence
  dgRNA
  Zkscan8
ccggaagtggctgtg

SEQ ID NO: 65135 - DNA, 15 bp, Artificial Sequence
  dgRNA
  Zkscan8
aagatgcgtgctgcc

SEQ ID NO: 65136 - DNA, 15 bp, Artificial Sequence
  dgRNA
  Zkscan8
ttccggaagctctct

SEQ ID NO: 65137 - DNA, 15 bp, Artificial Sequence
  dgRNA
  Apof
ggagtcatgcttggt

SEQ ID NO: 65138 - DNA, 15 bp, Artificial Sequence
  dgRNA
  Zfp709
aacctggggaccggc

SEQ ID NO: 65139 - DNA, 15 bp, Artificial Sequence
  dgRNA
  Zfp709
atgtgacactttagc

SEQ ID NO: 65140 - DNA, 15 bp, Artificial Sequence
  dgRNA
  Zfp709
gttttgagagccgca

SEQ ID NO: 65141 - DNA, 15 bp, Artificial Sequence
  dgRNA
  Zfp709
agccgcaaggatgcg

SEQ ID NO: 65142 - DNA, 15 bp, Artificial Sequence
  dgRNA
  Slc25a25
gcaacctgatactgc

SEQ ID NO: 65143 - DNA, 15 bp, Artificial Sequence
  dgRNA
  Slc25a25
tactgccggctactg

SEQ ID NO: 65144 - DNA, 15 bp, Artificial Sequence
  dgRNA
  Slc25a25
gaggactgtgcttat

SEQ ID NO: 65145 - DNA, 15 bp, Artificial Sequence
  dgRNA
  Slc25a25
tgcacttacagtggg

SEQ ID NO: 65146 - DNA, 15 bp, Artificial Sequence
  dgRNA
  Il1r1
gcctccacccccgga

SEQ ID NO: 65147 - DNA, 15 bp, Artificial Sequence
  dgRNA
  Il1r1
acaacccaacctatc

SEQ ID NO: 65148 - DNA, 15 bp, Artificial Sequence
  dgRNA
  Il1r1
acctatccggctccc

SEQ ID NO: 65149 - DNA, 15 bp, Artificial Sequence
  dgRNA
  Il1r1
cctatccggctccca

SEQ ID NO: 65150 - DNA, 15 bp, Artificial Sequence
  dgRNA
  Ap3s2
cttggattcgttccc

SEQ ID NO: 65151 - DNA, 15 bp, Artificial Sequence
  dgRNA
  Ap3s2
gattcgttcccaggc

SEQ ID NO: 65152 - DNA, 15 bp, Artificial Sequence
  dgRNA
  Ap3s2
aggcgaccgtgctcc

SEQ ID NO: 65153 - DNA, 15 bp, Artificial Sequence
  dgRNA
  Ap3s2
ggcgaccgtgctcct

SEQ ID NO: 65154 - DNA, 15 bp, Artificial Sequence
  dgRNA
  Speg
gagtctaaattcagc

SEQ ID NO: 65155 - DNA, 15 bp, Artificial Sequence
  dgRNA
  Speg
tattccaccactcca

SEQ ID NO: 65156 - DNA, 15 bp, Artificial Sequence
  dgRNA
  Speg
gtggaataggaacgg

SEQ ID NO: 65157 - DNA, 15 bp, Artificial Sequence
  dgRNA
  Speg
ggtggaataggaacg

SEQ ID NO: 65158 - DNA, 15 bp, Artificial Sequence
  dgRNA
  Elk3
ggggcccggcgccgg

SEQ ID NO: 65159 - DNA, 15 bp, Artificial Sequence
  dgRNA
  Elk3
cgccgggggtatgcg

SEQ ID NO: 65160 - DNA, 15 bp, Artificial Sequence
  dgRNA
  Elk3
gccgggggtatgcgc

SEQ ID NO: 65161 - DNA, 15 bp, Artificial Sequence
  dgRNA
  Elk3
gggtatgcgcgggtc

SEQ ID NO: 65162 - DNA, 15 bp, Artificial Sequence
  dgRNA
  Rsph1
ccccctcgtcctggg

SEQ ID NO: 65163 - DNA, 15 bp, Artificial Sequence
  dgRNA
  Rsph1
gtcctgggcggcgat

SEQ ID NO: 65164 - DNA, 15 bp, Artificial Sequence
  dgRNA
  Rsph1
ttccgccactctttc

SEQ ID NO: 65165 - DNA, 15 bp, Artificial Sequence
  dgRNA
  Rsph1
cgccactctttcagg

SEQ ID NO: 65166 - DNA, 15 bp, Artificial Sequence
  dgRNA
  Cecr5
cctctcggggaagcg

SEQ ID NO: 65167 - DNA, 15 bp, Artificial Sequence
  dgRNA
  Cecr5
ctctcggggaagcga

SEQ ID NO: 65168 - DNA, 15 bp, Artificial Sequence
  dgRNA
  Cecr5
tcgccattcagtgtc

SEQ ID NO: 65169 - DNA, 15 bp, Artificial Sequence
  dgRNA
  Cecr5
cgagcccgagctcca

SEQ ID NO: 65170 - DNA, 15 bp, Artificial Sequence
  dgRNA
  Slco1b2
aacaaagatctaggt

SEQ ID NO: 65171 - DNA, 15 bp, Artificial Sequence
  dgRNA
  Slco1b2
ctgtcctacacaaat

SEQ ID NO: 65172 - DNA, 15 bp, Artificial Sequence
  dgRNA
  Tmprss4
ggcattcaagcagat

SEQ ID NO: 65173 - DNA, 15 bp, Artificial Sequence
  dgRNA
  Tmprss4
cctatgaaccactcc

SEQ ID NO: 65174 - DNA, 15 bp, Artificial Sequence
  dgRNA
  Tmprss4
cctgcccctaacgac

SEQ ID NO: 65175 - DNA, 15 bp, Artificial Sequence
  dgRNA
  Tmprss4
ctgcccctaacgact

SEQ ID NO: 65176 - DNA, 15 bp, Artificial Sequence
  dgRNA
  Tdo2
ttgggagtagccact

SEQ ID NO: 65177 - DNA, 15 bp, Artificial Sequence
  dgRNA
  Smpx
aacgtagccacctcc

SEQ ID NO: 65178 - DNA, 15 bp, Artificial Sequence
  dgRNA
  Smpx
ctaatcttcttgagg

SEQ ID NO: 65179 - DNA, 15 bp, Artificial Sequence
  dgRNA
  Smpx
accgtgtggaaagca

SEQ ID NO: 65180 - DNA, 15 bp, Artificial Sequence
  dgRNA
  Smpx
gaccgtgtggaaagc

SEQ ID NO: 65181 - DNA, 15 bp, Artificial Sequence
  dgRNA
  Frs3
gccccgagcgccctc

SEQ ID NO: 65182 - DNA, 15 bp, Artificial Sequence
  dgRNA
  Frs3
ccaaagggaccttct

SEQ ID NO: 65183 - DNA, 15 bp, Artificial Sequence
  dgRNA
  Frs3
ttctaggctgcgtgc

SEQ ID NO: 65184 - DNA, 15 bp, Artificial Sequence
  dgRNA
  Frs3
gcgtgccggttgccc

SEQ ID NO: 65185 - DNA, 15 bp, Artificial Sequence
  dgRNA
  Tram2
aggcgcgcgcctttg

SEQ ID NO: 65186 - DNA, 15 bp, Artificial Sequence
  dgRNA
  Tram2
cgcgcctttgcggcc

SEQ ID NO: 65187 - DNA, 15 bp, Artificial Sequence
  dgRNA
  Tram2
gcgcctttgcggcct

SEQ ID NO: 65188 - DNA, 15 bp, Artificial Sequence
  dgRNA
  Tram2
cgcctttgcggcctg

SEQ ID NO: 65189 - DNA, 15 bp, Artificial Sequence
  dgRNA
  Rpl36al
tcatccttgctcgca

SEQ ID NO: 65190 - DNA, 15 bp, Artificial Sequence
  dgRNA
  Rpl36al
tccttgctcgcacgg

SEQ ID NO: 65191 - DNA, 15 bp, Artificial Sequence
  dgRNA
  Rpl36al
gctcgcacggcggaa

SEQ ID NO: 65192 - DNA, 15 bp, Artificial Sequence
  dgRNA
  Rpl36al
agcctcgccccgctc

SEQ ID NO: 65193 - DNA, 15 bp, Artificial Sequence
  dgRNA
  Gzmm
gtcactttcattgcg

SEQ ID NO: 65194 - DNA, 15 bp, Artificial Sequence
  dgRNA
  Gzmm
tcactttcattgcgt

SEQ ID NO: 65195 - DNA, 15 bp, Artificial Sequence
  dgRNA
  Gzmm
gaaaggcgttagttc

SEQ ID NO: 65196 - DNA, 15 bp, Artificial Sequence
  dgRNA
  Gzmm
agttataagcagcac

SEQ ID NO: 65197 - DNA, 15 bp, Artificial Sequence
  dgRNA
  D1Ertd622e
gcggcccgcattgtc

SEQ ID NO: 65198 - DNA, 15 bp, Artificial Sequence
  dgRNA
  D1Ertd622e
gctgcggctccccgg

SEQ ID NO: 65199 - DNA, 15 bp, Artificial Sequence
  dgRNA
  D1Ertd622e
ctgcggctccccgga

SEQ ID NO: 65200 - DNA, 15 bp, Artificial Sequence
  dgRNA
  D1Ertd622e
gctccccggagggtg

SEQ ID NO: 65201 - DNA, 15 bp, Artificial Sequence
  dgRNA
  Nox4
tcccattctcgcatc

SEQ ID NO: 65202 - DNA, 15 bp, Artificial Sequence
  dgRNA
  Nox4
cccattctcgcatct

SEQ ID NO: 65203 - DNA, 15 bp, Artificial Sequence
  dgRNA
  Nox4
ccattctcgcatctg

SEQ ID NO: 65204 - DNA, 15 bp, Artificial Sequence
  dgRNA
  Nox4
ctggacaggcccggc

SEQ ID NO: 65205 - DNA, 15 bp, Artificial Sequence
  dgRNA
  Zfp846
gataagaattagatc

SEQ ID NO: 65206 - DNA, 15 bp, Artificial Sequence
  dgRNA
  Zfp846
gaattagatcaggct

SEQ ID NO: 65207 - DNA, 15 bp, Artificial Sequence
  dgRNA
  Zfp846
tagatcaggcttggt

SEQ ID NO: 65208 - DNA, 15 bp, Artificial Sequence
  dgRNA
  Zfp846
tatctctatccaagg

SEQ ID NO: 65209 - DNA, 15 bp, Artificial Sequence
  dgRNA
  Mei1
tagcgacttcttaca

SEQ ID NO: 65210 - DNA, 15 bp, Artificial Sequence
  dgRNA
  Mei1
aaccctctcaaagtg

SEQ ID NO: 65211 - DNA, 15 bp, Artificial Sequence
  dgRNA
  Mei1
aaagtggggtcgcat

SEQ ID NO: 65212 - DNA, 15 bp, Artificial Sequence
  dgRNA
  Mei1
aagtggggtcgcata

SEQ ID NO: 65213 - DNA, 15 bp, Artificial Sequence
  dgRNA
  Cpxm1
ccccgggggtcctcg

SEQ ID NO: 65214 - DNA, 15 bp, Artificial Sequence
  dgRNA
  Cpxm1
agagtcagccgcccc

SEQ ID NO: 65215 - DNA, 15 bp, Artificial Sequence
  dgRNA
  Cpxm1
gagtcagccgccccc

SEQ ID NO: 65216 - DNA, 15 bp, Artificial Sequence
  dgRNA
  Cpxm1
agtcagccgcccccg

SEQ ID NO: 65217 - DNA, 15 bp, Artificial Sequence
  dgRNA
  Aass
gctaagtaagctcta

SEQ ID NO: 65218 - DNA, 15 bp, Artificial Sequence
  dgRNA
  Aass
gcatgacctagtacc

SEQ ID NO: 65219 - DNA, 15 bp, Artificial Sequence
  dgRNA
  Aass
ggcagcaccgctgat

SEQ ID NO: 65220 - DNA, 15 bp, Artificial Sequence
  dgRNA
  Aass
gcaccgctgattggt

SEQ ID NO: 65221 - DNA, 15 bp, Artificial Sequence
  dgRNA
  Fau
caccagcgatccgcg

SEQ ID NO: 65222 - DNA, 15 bp, Artificial Sequence
  dgRNA
  Fau
gacgtcacacgcagc

SEQ ID NO: 65223 - DNA, 15 bp, Artificial Sequence
  dgRNA
  Fau
acgcagcaggcggtg

SEQ ID NO: 65224 - DNA, 15 bp, Artificial Sequence
  dgRNA
  Fau
cgcgcggatcgctgg

SEQ ID NO: 65225 - DNA, 15 bp, Artificial Sequence
  dgRNA
  Acbd5
tacgccagcctacag

SEQ ID NO: 65226 - DNA, 15 bp, Artificial Sequence
  dgRNA
  Acbd5
ggtgtccggaagcgc

SEQ ID NO: 65227 - DNA, 15 bp, Artificial Sequence
  dgRNA
  Acbd5
gtgtccggaagcgcc

SEQ ID NO: 65228 - DNA, 15 bp, Artificial Sequence
  dgRNA
  Acbd5
tgtccggaagcgccg

SEQ ID NO: 65229 - DNA, 15 bp, Artificial Sequence
  dgRNA
  Appl2
gcctatcgtcccacc

SEQ ID NO: 65230 - DNA, 15 bp, Artificial Sequence
  dgRNA
  Appl2
gatgcgccatgagca

SEQ ID NO: 65231 - DNA, 15 bp, Artificial Sequence
  dgRNA
  Appl2
atgcgccatgagcac

SEQ ID NO: 65232 - DNA, 15 bp, Artificial Sequence
  dgRNA
  Appl2
tgcgccatgagcacg

SEQ ID NO: 65233 - DNA, 15 bp, Artificial Sequence
  dgRNA
  Mtdh
agactagagtccgcc

SEQ ID NO: 65234 - DNA, 15 bp, Artificial Sequence
  dgRNA
  Mtdh
tccacgtgacccgac

SEQ ID NO: 65235 - DNA, 15 bp, Artificial Sequence
  dgRNA
  Mtdh
cctccgcgcgcagcg

SEQ ID NO: 65236 - DNA, 15 bp, Artificial Sequence
  dgRNA
  Mtdh
gcgcagcgtggatcg

SEQ ID NO: 65237 - DNA, 15 bp, Artificial Sequence
  dgRNA
  Tsga10
catctcggcgctgcg

SEQ ID NO: 65238 - DNA, 15 bp, Artificial Sequence
  dgRNA
  Tsga10
ggccgtgcgcctgcg

SEQ ID NO: 65239 - DNA, 15 bp, Artificial Sequence
  dgRNA
  Tsga10
cctgcgcggcaccga

SEQ ID NO: 65240 - DNA, 15 bp, Artificial Sequence
  dgRNA
  Tsga10
ctgcgcggcaccgat

SEQ ID NO: 65241 - DNA, 15 bp, Artificial Sequence
  dgRNA
  Fam162a
cgccttcatcatgcc

SEQ ID NO: 65242 - DNA, 15 bp, Artificial Sequence
  dgRNA
  Fam162a
tcatcatgcccgggc

SEQ ID NO: 65243 - DNA, 15 bp, Artificial Sequence
  dgRNA
  Fam162a
cccgctgcgtcacgc

SEQ ID NO: 65244 - DNA, 15 bp, Artificial Sequence
  dgRNA
  Fam162a
agcgccctccccacg

SEQ ID NO: 65245 - DNA, 15 bp, Artificial Sequence
  dgRNA
  Polr2c
agttataaataacgt

SEQ ID NO: 65246 - DNA, 15 bp, Artificial Sequence
  dgRNA
  Polr2c
gtgctgtatatcttg

SEQ ID NO: 65247 - DNA, 15 bp, Artificial Sequence
  dgRNA
  Polr2c
ggatttcaagagtat

SEQ ID NO: 65248 - DNA, 15 bp, Artificial Sequence
  dgRNA
  Polr2c
attttggcgccggtg

SEQ ID NO: 65249 - DNA, 15 bp, Artificial Sequence
  dgRNA
  Mical1
tgcaagaaccgagag

SEQ ID NO: 65250 - DNA, 15 bp, Artificial Sequence
  dgRNA
  Avpr1a
gctggagaaattccg

SEQ ID NO: 65251 - DNA, 15 bp, Artificial Sequence
  dgRNA
  Avpr1a
gatccggaaagcgcc

SEQ ID NO: 65252 - DNA, 15 bp, Artificial Sequence
  dgRNA
  Avpr1a
atgcagcgcgtcaac

SEQ ID NO: 65253 - DNA, 15 bp, Artificial Sequence
  dgRNA
  Avpr1a
gagccgggcgctttc

SEQ ID NO: 65254 - DNA, 15 bp, Artificial Sequence
  dgRNA
  Zfp609
ggttgtcccggatcg

SEQ ID NO: 65255 - DNA, 15 bp, Artificial Sequence
  dgRNA
  Zfp609
tgtcccggatcgcgg

SEQ ID NO: 65256 - DNA, 15 bp, Artificial Sequence
  dgRNA
  Zfp609
cccggatcgcggcgg

SEQ ID NO: 65257 - DNA, 15 bp, Artificial Sequence
  dgRNA
  Zfp609
agggacccgcagccc

SEQ ID NO: 65258 - DNA, 15 bp, Artificial Sequence
  dgRNA
  Atp5s
ccgcctacgtagcgc

SEQ ID NO: 65259 - DNA, 15 bp, Artificial Sequence
  dgRNA
  Atp5s
cgcctacgtagcgca

SEQ ID NO: 65260 - DNA, 15 bp, Artificial Sequence
  dgRNA
  Atp5s
tacgtagcgcagggt

SEQ ID NO: 65261 - DNA, 15 bp, Artificial Sequence
  dgRNA
  Atp5s
gcagggtcggccaca

SEQ ID NO: 65262 - DNA, 15 bp, Artificial Sequence
  dgRNA
  Card10
gttgtgctcatggtg

SEQ ID NO: 65263 - DNA, 15 bp, Artificial Sequence
  dgRNA
  Card10
cggcggcagtggccc

SEQ ID NO: 65264 - DNA, 15 bp, Artificial Sequence
  dgRNA
  Card10
cggcagtggccctgg

SEQ ID NO: 65265 - DNA, 15 bp, Artificial Sequence
  dgRNA
  Card10
cagtggccctggcgg

SEQ ID NO: 65266 - DNA, 15 bp, Artificial Sequence
  dgRNA
  Adipoq
aagctggattaaacc

SEQ ID NO: 65267 - DNA, 15 bp, Artificial Sequence
  dgRNA
  Adipoq
aaaccaggttcccta

SEQ ID NO: 65268 - DNA, 15 bp, Artificial Sequence
  dgRNA
  Adipoq
ccctaaggagtctta

SEQ ID NO: 65269 - DNA, 15 bp, Artificial Sequence
  dgRNA
  Adipoq
aaggggcccactcat

SEQ ID NO: 65270 - DNA, 15 bp, Artificial Sequence
  dgRNA
  Fam96a
cgttacacgatcctc

SEQ ID NO: 65271 - DNA, 15 bp, Artificial Sequence
  dgRNA
  Fam96a
atgcaatgcgcctaa

SEQ ID NO: 65272 - DNA, 15 bp, Artificial Sequence
  dgRNA
  Fam96a
caaggttactactac

SEQ ID NO: 65273 - DNA, 15 bp, Artificial Sequence
  dgRNA
  Fam96a
cagaggatcgtgtaa

SEQ ID NO: 65274 - DNA, 15 bp, Artificial Sequence
  dgRNA
  Prrx2
cccgaaccttccttt

SEQ ID NO: 65275 - DNA, 15 bp, Artificial Sequence
  dgRNA
  Prrx2
accttcctttcggca

SEQ ID NO: 65276 - DNA, 15 bp, Artificial Sequence
  dgRNA
  Prrx2
ttcctttcggcatgg

SEQ ID NO: 65277 - DNA, 15 bp, Artificial Sequence
  dgRNA
  Prrx2
tcctttcggcatgga

SEQ ID NO: 65278 - DNA, 15 bp, Artificial Sequence
  dgRNA
  Sytl4
actttccctggagcg

SEQ ID NO: 65279 - DNA, 15 bp, Artificial Sequence
  dgRNA
  Asb17
acggcatagacagag

SEQ ID NO: 65280 - DNA, 15 bp, Artificial Sequence
  dgRNA
  Asb17
cttcacaaccgcctc

SEQ ID NO: 65281 - DNA, 15 bp, Artificial Sequence
  dgRNA
  Asb17
gacccgggctgatga

SEQ ID NO: 65282 - DNA, 15 bp, Artificial Sequence
  dgRNA
  Asb17
tgatgacggctctgc

SEQ ID NO: 65283 - DNA, 15 bp, Artificial Sequence
  dgRNA
  Rpl10a
gctcatcaccaaatt

SEQ ID NO: 65284 - DNA, 15 bp, Artificial Sequence
  dgRNA
  Rpl10a
caaattaggcgatga

SEQ ID NO: 65285 - DNA, 15 bp, Artificial Sequence
  dgRNA
  Rpl10a
ggcgatgacggagac

SEQ ID NO: 65286 - DNA, 15 bp, Artificial Sequence
  dgRNA
  Rpl10a
ggagaccggttctgc

SEQ ID NO: 65287 - DNA, 15 bp, Artificial Sequence
  dgRNA
  Mrps9
aggcttgtctgagcg

SEQ ID NO: 65288 - DNA, 15 bp, Artificial Sequence
  dgRNA
  Mrps9
ggcttgtctgagcgt

SEQ ID NO: 65289 - DNA, 15 bp, Artificial Sequence
  dgRNA
  Mrps9
ctgagcgtgggtacc

SEQ ID NO: 65290 - DNA, 15 bp, Artificial Sequence
  dgRNA
  Mrps9
cgaaagccatgtgca

SEQ ID NO: 65291 - DNA, 15 bp, Artificial Sequence
  dgRNA
  Dmp1
gggtgtatggggtcc

SEQ ID NO: 65292 - DNA, 15 bp, Artificial Sequence
  dgRNA
  Dmp1
gtcaccccgagcctg

SEQ ID NO: 65293 - DNA, 15 bp, Artificial Sequence
  dgRNA
  Slc12a3
tgatcagataaatgg

SEQ ID NO: 65294 - DNA, 15 bp, Artificial Sequence
  dgRNA
  Slc12a3
ctgctcacttgccat

SEQ ID NO: 65295 - DNA, 15 bp, Artificial Sequence
  dgRNA
  Slc12a3
ttgccatgggcggtc

SEQ ID NO: 65296 - DNA, 15 bp, Artificial Sequence
  dgRNA
  Slc12a3
ccaatttggagcagg

SEQ ID NO: 65297 - DNA, 15 bp, Artificial Sequence
  dgRNA
  Syt8
ggtctggtgggcacc

SEQ ID NO: 65298 - DNA, 15 bp, Artificial Sequence
  dgRNA
  Syt8
aagttggcatggccc

SEQ ID NO: 65299 - DNA, 15 bp, Artificial Sequence
  dgRNA
  U2af1l4
aaaacacgcgcttga

SEQ ID NO: 65300 - DNA, 15 bp, Artificial Sequence
  dgRNA
  U2af1l4
cgcgcttgacggtcg

SEQ ID NO: 65301 - DNA, 15 bp, Artificial Sequence
  dgRNA
  U2af1l4
cttgacggtcgagga

SEQ ID NO: 65302 - DNA, 15 bp, Artificial Sequence
  dgRNA
  U2af1l4
tcgaggacggtccgc

SEQ ID NO: 65303 - DNA, 15 bp, Artificial Sequence
  dgRNA
  Trmt2a
cgcacttccgcctgc

SEQ ID NO: 65304 - DNA, 15 bp, Artificial Sequence
  dgRNA
  Trmt2a
gagtgcctccgacgc

SEQ ID NO: 65305 - DNA, 15 bp, Artificial Sequence
  dgRNA
  Trmt2a
cgacgctggcgtgag

SEQ ID NO: 65306 - DNA, 15 bp, Artificial Sequence
  dgRNA
  Trmt2a
ggcgtgagcggctgc

SEQ ID NO: 65307 - DNA, 15 bp, Artificial Sequence
  dgRNA
  AW209491
accacgtaatgccag

SEQ ID NO: 65308 - DNA, 15 bp, Artificial Sequence
  dgRNA
  AW209491
acgtaatgccagagg

SEQ ID NO: 65309 - DNA, 15 bp, Artificial Sequence
  dgRNA
  AW209491
cgtaatgccagaggc

SEQ ID NO: 65310 - DNA, 15 bp, Artificial Sequence
  dgRNA
  AW209491
gcctctggcattacg

SEQ ID NO: 65311 - DNA, 15 bp, Artificial Sequence
  dgRNA
  Rbpj
gtctcgccgcgtgtg

SEQ ID NO: 65312 - DNA, 15 bp, Artificial Sequence
  dgRNA
  Rbpj
tctcgccgcgtgtgc

SEQ ID NO: 65313 - DNA, 15 bp, Artificial Sequence
  dgRNA
  Rbpj
cgtgtgcgggtcgtg

SEQ ID NO: 65314 - DNA, 15 bp, Artificial Sequence
  dgRNA
  Rbpj
gtgtgcgggtcgtgc

SEQ ID NO: 65315 - DNA, 15 bp, Artificial Sequence
  dgRNA
  Dhps
ggggacaagaatatt

SEQ ID NO: 65316 - DNA, 15 bp, Artificial Sequence
  dgRNA
  Dhps
gacagcttgcaaact

SEQ ID NO: 65317 - DNA, 15 bp, Artificial Sequence
  dgRNA
  Dhps
cctggaccacatgta

SEQ ID NO: 65318 - DNA, 15 bp, Artificial Sequence
  dgRNA
  Dhps
acatgtacggaacac

SEQ ID NO: 65319 - DNA, 15 bp, Artificial Sequence
  dgRNA
  Ap5s1
gacgcgctcagctgg

SEQ ID NO: 65320 - DNA, 15 bp, Artificial Sequence
  dgRNA
  Gm960
ccaaatcttattgca

SEQ ID NO: 65321 - DNA, 15 bp, Artificial Sequence
  dgRNA
  Gm960
ggcacacataatacg

SEQ ID NO: 65322 - DNA, 15 bp, Artificial Sequence
  dgRNA
  Gm960
taatacggggtaaaa

SEQ ID NO: 65323 - DNA, 15 bp, Artificial Sequence
  dgRNA
  Gm960
ccagtctattccagg

SEQ ID NO: 65324 - DNA, 15 bp, Artificial Sequence
  dgRNA
  Olfr1126
tatactaaatgttat

SEQ ID NO: 65325 - DNA, 15 bp, Artificial Sequence
  dgRNA
  Olfr1126
tgtagggatgatcaa

SEQ ID NO: 65326 - DNA, 15 bp, Artificial Sequence
  dgRNA
  Abhd17b
tgcgcagtttgtgat

SEQ ID NO: 65327 - DNA, 15 bp, Artificial Sequence
  dgRNA
  Abhd17b
gcagtttgtgattgg

SEQ ID NO: 65328 - DNA, 15 bp, Artificial Sequence
  dgRNA
  Abhd17b
tgatcgcctgcagcc

SEQ ID NO: 65329 - DNA, 15 bp, Artificial Sequence
  dgRNA
  Abhd17b
agcccgggtcagctt

SEQ ID NO: 65330 - DNA, 15 bp, Artificial Sequence
  dgRNA
  Morn1
aaccatttccgcttc

SEQ ID NO: 65331 - DNA, 15 bp, Artificial Sequence
  dgRNA
  Morn1
tttccgcttccggta

SEQ ID NO: 65332 - DNA, 15 bp, Artificial Sequence
  dgRNA
  Morn1
ccggtatggacgcag

SEQ ID NO: 65333 - DNA, 15 bp, Artificial Sequence
  dgRNA
  Morn1
cgcagaggccgttgg

SEQ ID NO: 65334 - DNA, 15 bp, Artificial Sequence
  dgRNA
  Pinlyp
tggatgctggttccg

SEQ ID NO: 65335 - DNA, 15 bp, Artificial Sequence
  dgRNA
  Pinlyp
ggtgcagagcaactt

SEQ ID NO: 65336 - DNA, 15 bp, Artificial Sequence
  dgRNA
  Pinlyp
tccgggtcagagcca

SEQ ID NO: 65337 - DNA, 15 bp, Artificial Sequence
  dgRNA
  Pcdhga1
atctgacagtaaacc

SEQ ID NO: 65338 - DNA, 15 bp, Artificial Sequence
  dgRNA
  Pcdhga1
gtgcagtaacttgtt

SEQ ID NO: 65339 - DNA, 15 bp, Artificial Sequence
  dgRNA
  Pcdhga1
cgctgttcaccaagc

SEQ ID NO: 65340 - DNA, 15 bp, Artificial Sequence
  dgRNA
  Pcdhga1
aggtatcttaagtcc

SEQ ID NO: 65341 - DNA, 15 bp, Artificial Sequence
  dgRNA
  Cutc
cgagccagcaggagt

SEQ ID NO: 65342 - DNA, 15 bp, Artificial Sequence
  dgRNA
  Cutc
tctggacgccaccct

SEQ ID NO: 65343 - DNA, 15 bp, Artificial Sequence
  dgRNA
  Cutc
ctggacgccacccta

SEQ ID NO: 65344 - DNA, 15 bp, Artificial Sequence
  dgRNA
  Cutc
gccaccctagggacc

SEQ ID NO: 65345 - DNA, 15 bp, Artificial Sequence
  dgRNA
  Pakap
cgctagcattgcctc

SEQ ID NO: 65346 - DNA, 15 bp, Artificial Sequence
  dgRNA
  Pakap
catcctgggccgact

SEQ ID NO: 65347 - DNA, 15 bp, Artificial Sequence
  dgRNA
  Pakap
atcctgggccgacta

SEQ ID NO: 65348 - DNA, 15 bp, Artificial Sequence
  dgRNA
  Pakap
ctgggccgactaggg

SEQ ID NO: 65349 - DNA, 15 bp, Artificial Sequence
  dgRNA
  Zfp541
agctagctgccagcg

SEQ ID NO: 65350 - DNA, 15 bp, Artificial Sequence
  dgRNA
  Zfp541
gctagctgccagcga

SEQ ID NO: 65351 - DNA, 15 bp, Artificial Sequence
  dgRNA
  Zfp541
acggctttgcttgtc

SEQ ID NO: 65352 - DNA, 15 bp, Artificial Sequence
  dgRNA
  Zfp541
agacgggctctagcc

SEQ ID NO: 65353 - DNA, 15 bp, Artificial Sequence
  dgRNA
  Gm595
gagccacatccatta

SEQ ID NO: 65354 - DNA, 15 bp, Artificial Sequence
  dgRNA
  Gm595
tggaaacttctagtg

SEQ ID NO: 65355 - DNA, 15 bp, Artificial Sequence
  dgRNA
  Gm595
ggtgtgacgtgtctt

SEQ ID NO: 65356 - DNA, 15 bp, Artificial Sequence
  dgRNA
  Gm595
gtgtgacgtgtctta

SEQ ID NO: 65357 - DNA, 15 bp, Artificial Sequence
  dgRNA
  Pla2g1b
ggaaaccatcccctt

SEQ ID NO: 65358 - DNA, 15 bp, Artificial Sequence
  dgRNA
  Pla2g1b
gaaaccatccccttg

SEQ ID NO: 65359 - DNA, 15 bp, Artificial Sequence
  dgRNA
  Pla2g1b
accatccccttgggg

SEQ ID NO: 65360 - DNA, 15 bp, Artificial Sequence
  dgRNA
  Pla2g1b
ccaggcgcaaatctg

SEQ ID NO: 65361 - DNA, 15 bp, Artificial Sequence
  dgRNA
  Zfp442
ttccgggagctttcc

SEQ ID NO: 65362 - DNA, 15 bp, Artificial Sequence
  dgRNA
  Zfp442
tccgggagctttcct

SEQ ID NO: 65363 - DNA, 15 bp, Artificial Sequence
  dgRNA
  Zfp442
gcgtggaataattcc

SEQ ID NO: 65364 - DNA, 15 bp, Artificial Sequence
  dgRNA
  Card11
ggcctggctgtaatg

SEQ ID NO: 65365 - DNA, 15 bp, Artificial Sequence
  dgRNA
  Card11
tgagcctaaggcttt

SEQ ID NO: 65366 - DNA, 15 bp, Artificial Sequence
  dgRNA
  Card11
tgtcataggctggta

SEQ ID NO: 65367 - DNA, 15 bp, Artificial Sequence
  dgRNA
  Card11
gtgtcataggctggt

SEQ ID NO: 65368 - DNA, 15 bp, Artificial Sequence
  dgRNA
  Mmd
acctaccgagcttca

SEQ ID NO: 65369 - DNA, 15 bp, Artificial Sequence
  dgRNA
  Mmd
agccctgcgccgctc

SEQ ID NO: 65370 - DNA, 15 bp, Artificial Sequence
  dgRNA
  Mmd
gctccggacactgat

SEQ ID NO: 65371 - DNA, 15 bp, Artificial Sequence
  dgRNA
  Mmd
attggccactgggcg

SEQ ID NO: 65372 - DNA, 15 bp, Artificial Sequence
  dgRNA
  Vamp2
gggctgtatggattt

SEQ ID NO: 65373 - DNA, 15 bp, Artificial Sequence
  dgRNA
  Vamp2
tatggatttcggttg

SEQ ID NO: 65374 - DNA, 15 bp, Artificial Sequence
  dgRNA
  Vamp2
atggatttcggttgt

SEQ ID NO: 65375 - DNA, 15 bp, Artificial Sequence
  dgRNA
  Vamp2
cttgggggcggcagt

SEQ ID NO: 65376 - DNA, 15 bp, Artificial Sequence
  dgRNA
  Cyp17a1
tagcgcagaagcccc

SEQ ID NO: 65377 - DNA, 15 bp, Artificial Sequence
  dgRNA
  Cyp17a1
agcgcagaagcccca

SEQ ID NO: 65378 - DNA, 15 bp, Artificial Sequence
  dgRNA
  Cyp17a1
atcagattaagatca

SEQ ID NO: 65379 - DNA, 15 bp, Artificial Sequence
  dgRNA
  Cyp17a1
tatggatcctcccag

SEQ ID NO: 65380 - DNA, 15 bp, Artificial Sequence
  dgRNA
  Trim65
ggaacacaaatagtc

SEQ ID NO: 65381 - DNA, 15 bp, Artificial Sequence
  dgRNA
  Trim65
cacaaatagtcaggg

SEQ ID NO: 65382 - DNA, 15 bp, Artificial Sequence
  dgRNA
  Trim65
atagtcagggtggac

SEQ ID NO: 65383 - DNA, 15 bp, Artificial Sequence
  dgRNA
  Trim65
gtcagggtggaccgg

SEQ ID NO: 65384 - DNA, 15 bp, Artificial Sequence
  dgRNA
  D17Wsu92e
gcgagcggtgcggtg

SEQ ID NO: 65385 - DNA, 15 bp, Artificial Sequence
  dgRNA
  D17Wsu92e
cggtgcggcgcggct

SEQ ID NO: 65386 - DNA, 15 bp, Artificial Sequence
  dgRNA
  D17Wsu92e
tcgctcctctctcgc

SEQ ID NO: 65387 - DNA, 15 bp, Artificial Sequence
  dgRNA
  C1qa
gtcccaaacgtgctg

SEQ ID NO: 65388 - DNA, 15 bp, Artificial Sequence
  dgRNA
  C1qa
taaaatttccgtgtg

SEQ ID NO: 65389 - DNA, 15 bp, Artificial Sequence
  dgRNA
  C1qa
tccgtgtgtggtgtc

SEQ ID NO: 65390 - DNA, 15 bp, Artificial Sequence
  dgRNA
  C1qa
gcacgtttgggacag

SEQ ID NO: 65391 - DNA, 15 bp, Artificial Sequence
  dgRNA
  Nxph1
tcaggaggttcaaat

SEQ ID NO: 65392 - DNA, 15 bp, Artificial Sequence
  dgRNA
  Nxph1
cacgggtacctaatc

SEQ ID NO: 65393 - DNA, 15 bp, Artificial Sequence
  dgRNA
  Nxph1
acgggtacctaatcc

SEQ ID NO: 65394 - DNA, 15 bp, Artificial Sequence
  dgRNA
  Nxph1
cttttttgaacgaag

SEQ ID NO: 65395 - DNA, 15 bp, Artificial Sequence
  dgRNA
  Hs3st2
ggtcaaggctccgta

SEQ ID NO: 65396 - DNA, 15 bp, Artificial Sequence
  dgRNA
  Hs3st2
tcatggggagaacct

SEQ ID NO: 65397 - DNA, 15 bp, Artificial Sequence
  dgRNA
  Hs3st2
ggcgggccaggtccc

SEQ ID NO: 65398 - DNA, 15 bp, Artificial Sequence
  dgRNA
  Hs3st2
gcgggccaggtcccc

SEQ ID NO: 65399 - DNA, 15 bp, Artificial Sequence
  dgRNA
  1700088E04Rik
cgctccttgttacca

SEQ ID NO: 65400 - DNA, 15 bp, Artificial Sequence
  dgRNA
  Cfap20
cactgtaaacacgtg

SEQ ID NO: 65401 - DNA, 15 bp, Artificial Sequence
  dgRNA
  Cfap20
accaagtctgggccc

SEQ ID NO: 65402 - DNA, 15 bp, Artificial Sequence
  dgRNA
  Cfap20
aagtctgggccccgg

SEQ ID NO: 65403 - DNA, 15 bp, Artificial Sequence
  dgRNA
  Cfap20
gtctgggccccggcg

SEQ ID NO: 65404 - DNA, 15 bp, Artificial Sequence
  dgRNA
  Ecscr
gctggttgaaatgac

SEQ ID NO: 65405 - DNA, 15 bp, Artificial Sequence
  dgRNA
  Ecscr
ctctcagattgtcgc

SEQ ID NO: 65406 - DNA, 15 bp, Artificial Sequence
  dgRNA
  Ecscr
gctggcagtcgtgag

SEQ ID NO: 65407 - DNA, 15 bp, Artificial Sequence
  dgRNA
  Ecscr
aggatcctctaatta

SEQ ID NO: 65408 - DNA, 15 bp, Artificial Sequence
  dgRNA
  Nelfa
gcccagcgcgctctc

SEQ ID NO: 65409 - DNA, 15 bp, Artificial Sequence
  dgRNA
  Nelfa
caatgagccgcacac

SEQ ID NO: 65410 - DNA, 15 bp, Artificial Sequence
  dgRNA
  Nelfa
aatgagccgcacacc

SEQ ID NO: 65411 - DNA, 15 bp, Artificial Sequence
  dgRNA
  Nelfa
tgttgcgcctcactg

SEQ ID NO: 65412 - DNA, 15 bp, Artificial Sequence
  dgRNA
  Pcdhb1
ctctgctcaacgcta

SEQ ID NO: 65413 - DNA, 15 bp, Artificial Sequence
  dgRNA
  Pcdhb1
atacgttcaatagcc

SEQ ID NO: 65414 - DNA, 15 bp, Artificial Sequence
  dgRNA
  Pcdhb1
tacgttcaatagcct

SEQ ID NO: 65415 - DNA, 15 bp, Artificial Sequence
  dgRNA
  Pcdhb1
acgttcaatagcctg

SEQ ID NO: 65416 - DNA, 15 bp, Artificial Sequence
  dgRNA
  Phex
actatgactgatttt

SEQ ID NO: 65417 - DNA, 15 bp, Artificial Sequence
  dgRNA
  Phex
gctgatggtttggac

SEQ ID NO: 65418 - DNA, 15 bp, Artificial Sequence
  dgRNA
  Ube2v2
agagcaacgcgctgc

SEQ ID NO: 65419 - DNA, 15 bp, Artificial Sequence
  dgRNA
  Ube2v2
cgtcaacgtcacttc

SEQ ID NO: 65420 - DNA, 15 bp, Artificial Sequence
  dgRNA
  Mogat1
atggtcaaatacggg

SEQ ID NO: 65421 - DNA, 15 bp, Artificial Sequence
  dgRNA
  Mogat1
gtcaaatacgggtgg

SEQ ID NO: 65422 - DNA, 15 bp, Artificial Sequence
  dgRNA
  Mogat1
tacgggtggaggccc

SEQ ID NO: 65423 - DNA, 15 bp, Artificial Sequence
  dgRNA
  Mogat1
ccaggccctagcgat

SEQ ID NO: 65424 - DNA, 15 bp, Artificial Sequence
  dgRNA
  Hmbs
gttaggagtacatcc

SEQ ID NO: 65425 - DNA, 15 bp, Artificial Sequence
  dgRNA
  Hmbs
atcctggtggtacta

SEQ ID NO: 65426 - DNA, 15 bp, Artificial Sequence
  dgRNA
  Hmbs
tcctggtggtactaa

SEQ ID NO: 65427 - DNA, 15 bp, Artificial Sequence
  dgRNA
  Hmbs
cttagtgactcaccc

SEQ ID NO: 65428 - DNA, 15 bp, Artificial Sequence
  dgRNA
  Glt28d2
cagttcaagtttcgg

SEQ ID NO: 65429 - DNA, 15 bp, Artificial Sequence
  dgRNA
  Glt28d2
gaaactttctcgcag

SEQ ID NO: 65430 - DNA, 15 bp, Artificial Sequence
  dgRNA
  Glt28d2
ccgcccccttcacct

SEQ ID NO: 65431 - DNA, 15 bp, Artificial Sequence
  dgRNA
  Glt28d2
ccgagcacctggcgg

SEQ ID NO: 65432 - DNA, 15 bp, Artificial Sequence
  dgRNA
  Dtd1
gacatagtggagact

SEQ ID NO: 65433 - DNA, 15 bp, Artificial Sequence
  dgRNA
  Dtd1
actaggctggcagtt

SEQ ID NO: 65434 - DNA, 15 bp, Artificial Sequence
  dgRNA
  Dtd1
ctatagtgcttaaga

SEQ ID NO: 65435 - DNA, 15 bp, Artificial Sequence
  dgRNA
  Dtd1
cttaagaaggagttc

SEQ ID NO: 65436 - DNA, 15 bp, Artificial Sequence
  dgRNA
  Prelp
aaagtgagccgttag

SEQ ID NO: 65437 - DNA, 15 bp, Artificial Sequence
  dgRNA
  Prelp
aagtgagccgttagc

SEQ ID NO: 65438 - DNA, 15 bp, Artificial Sequence
  dgRNA
  Prelp
gccgttagcgggcat

SEQ ID NO: 65439 - DNA, 15 bp, Artificial Sequence
  dgRNA
  Prelp
ccgttagcgggcatc

SEQ ID NO: 65440 - DNA, 15 bp, Artificial Sequence
  dgRNA
  Fhl2
tgtggtagcgtcatc

SEQ ID NO: 65441 - DNA, 15 bp, Artificial Sequence
  dgRNA
  Fhl2
gtggtagcgtcatca

SEQ ID NO: 65442 - DNA, 15 bp, Artificial Sequence
  dgRNA
  Fhl2
tggtagcgtcatcag

SEQ ID NO: 65443 - DNA, 15 bp, Artificial Sequence
  dgRNA
  Fhl2
ggaacagacgacgac

SEQ ID NO: 65444 - DNA, 15 bp, Artificial Sequence
  dgRNA
  Ttll2
ggatcagcactgtat

SEQ ID NO: 65445 - DNA, 15 bp, Artificial Sequence
  dgRNA
  Praf2
cttctaggaacctgt

SEQ ID NO: 65446 - DNA, 15 bp, Artificial Sequence
  dgRNA
  Praf2
gaacctgtcgggaag

SEQ ID NO: 65447 - DNA, 15 bp, Artificial Sequence
  dgRNA
  Praf2
gcctgtactgtccgg

SEQ ID NO: 65448 - DNA, 15 bp, Artificial Sequence
  dgRNA
  Praf2
ggtggtgccccgccc

SEQ ID NO: 65449 - DNA, 15 bp, Artificial Sequence
  dgRNA
  Tmem265
acaagcatccgtgta

SEQ ID NO: 65450 - DNA, 15 bp, Artificial Sequence
  dgRNA
  Tmem265
agcatccgtgtaagg

SEQ ID NO: 65451 - DNA, 15 bp, Artificial Sequence
  dgRNA
  Tmem265
ctgatctctaatgca

SEQ ID NO: 65452 - DNA, 15 bp, Artificial Sequence
  dgRNA
  Tmem265
gtcattgtaagaggg

SEQ ID NO: 65453 - DNA, 15 bp, Artificial Sequence
  dgRNA
  Fos
aatgtgaacactcat

SEQ ID NO: 65454 - DNA, 15 bp, Artificial Sequence
  dgRNA
  Fos
gatgtatgccaagac

SEQ ID NO: 65455 - DNA, 15 bp, Artificial Sequence
  dgRNA
  Fos
atgtatgccaagacg

SEQ ID NO: 65456 - DNA, 15 bp, Artificial Sequence
  dgRNA
  Fos
tgtatgccaagacgg

SEQ ID NO: 65457 - DNA, 15 bp, Artificial Sequence
  dgRNA
  Fam53b
aataggtctgcctga

SEQ ID NO: 65458 - DNA, 15 bp, Artificial Sequence
  dgRNA
  Fam53b
ataggtctgcctgat

SEQ ID NO: 65459 - DNA, 15 bp, Artificial Sequence
  dgRNA
  Fam53b
gtctgcctgatgggc

SEQ ID NO: 65460 - DNA, 15 bp, Artificial Sequence
  dgRNA
  Fam53b
ggtcatgattgtctt

SEQ ID NO: 65461 - DNA, 15 bp, Artificial Sequence
  dgRNA
  Amot
agaagatgagaaccg

SEQ ID NO: 65462 - DNA, 15 bp, Artificial Sequence
  dgRNA
  Amot
ccagcgcctcacgcc

SEQ ID NO: 65463 - DNA, 15 bp, Artificial Sequence
  dgRNA
  Amot
gatgcaccaagatga

SEQ ID NO: 65464 - DNA, 15 bp, Artificial Sequence
  dgRNA
  Amot
cgagatcttaagcaa

SEQ ID NO: 65465 - DNA, 15 bp, Artificial Sequence
  dgRNA
  Fundc1
aacttagagcaggtt

SEQ ID NO: 65466 - DNA, 15 bp, Artificial Sequence
  dgRNA
  Fundc1
acttagagcaggttg

SEQ ID NO: 65467 - DNA, 15 bp, Artificial Sequence
  dgRNA
  Fundc1
cccataagcaatagg

SEQ ID NO: 65468 - DNA, 15 bp, Artificial Sequence
  dgRNA
  Fundc1
agcaataggagggcg

SEQ ID NO: 65469 - DNA, 15 bp, Artificial Sequence
  dgRNA
  F8
gcctatgactacctg

SEQ ID NO: 65470 - DNA, 15 bp, Artificial Sequence
  dgRNA
  F8
tacaggtatcctatc

SEQ ID NO: 65471 - DNA, 15 bp, Artificial Sequence
  dgRNA
  F8
gatctctaggccatg

SEQ ID NO: 65472 - DNA, 15 bp, Artificial Sequence
  dgRNA
  F8
atctctaggccatgt

SEQ ID NO: 65473 - DNA, 15 bp, Artificial Sequence
  dgRNA
  Atf1
tcccgcccgcgagag

SEQ ID NO: 65474 - DNA, 15 bp, Artificial Sequence
  dgRNA
  Atf1
cccgcccgcgagaga

SEQ ID NO: 65475 - DNA, 15 bp, Artificial Sequence
  dgRNA
  Atf1
gcccgcgagagaggg

SEQ ID NO: 65476 - DNA, 15 bp, Artificial Sequence
  dgRNA
  Atf1
ttgccccaagatccc

SEQ ID NO: 65477 - DNA, 15 bp, Artificial Sequence
  dgRNA
  Eif2b2
ccgggcctcccggct

SEQ ID NO: 65478 - DNA, 15 bp, Artificial Sequence
  dgRNA
  Eif2b2
gcgcgcagactccca

SEQ ID NO: 65479 - DNA, 15 bp, Artificial Sequence
  dgRNA
  Eif2b2
cgcgcagactcccaa

SEQ ID NO: 65480 - DNA, 15 bp, Artificial Sequence
  dgRNA
  Eif2b2
gcgcagactcccaag

SEQ ID NO: 65481 - DNA, 15 bp, Artificial Sequence
  dgRNA
  Egfr
cagagccttgtctag

SEQ ID NO: 65482 - DNA, 15 bp, Artificial Sequence
  dgRNA
  Egfr
gtctagtggtggcca

SEQ ID NO: 65483 - DNA, 15 bp, Artificial Sequence
  dgRNA
  Egfr
tgctttcgatcctcg

SEQ ID NO: 65484 - DNA, 15 bp, Artificial Sequence
  dgRNA
  Egfr
cagcgggtcagtggg

SEQ ID NO: 65485 - DNA, 15 bp, Artificial Sequence
  dgRNA
  Tfe3
cggtctctcagttcc

SEQ ID NO: 65486 - DNA, 15 bp, Artificial Sequence
  dgRNA
  Tfe3
tgcaccattcccgtc

SEQ ID NO: 65487 - DNA, 15 bp, Artificial Sequence
  dgRNA
  Tfe3
gcaccattcccgtct

SEQ ID NO: 65488 - DNA, 15 bp, Artificial Sequence
  dgRNA
  Tfe3
ccattcccgtctggg

SEQ ID NO: 65489 - DNA, 15 bp, Artificial Sequence
  dgRNA
  Psmf1
gaagtctactgtagt

SEQ ID NO: 65490 - DNA, 15 bp, Artificial Sequence
  dgRNA
  Psmf1
caggaacgaacagcc

SEQ ID NO: 65491 - DNA, 15 bp, Artificial Sequence
  dgRNA
  Psmf1
gcagtcgcctgctgc

SEQ ID NO: 65492 - DNA, 15 bp, Artificial Sequence
  dgRNA
  Psmf1
ctgcgcgcttcttag

SEQ ID NO: 65493 - DNA, 15 bp, Artificial Sequence
  dgRNA
  Ankrd54
actctaatttgtgat

SEQ ID NO: 65494 - DNA, 15 bp, Artificial Sequence
  dgRNA
  Ankrd54
attggtccgttgctc

SEQ ID NO: 65495 - DNA, 15 bp, Artificial Sequence
  dgRNA
  Ankrd54
tccgttgctctggcg

SEQ ID NO: 65496 - DNA, 15 bp, Artificial Sequence
  dgRNA
  Ankrd54
cgcactctgttgctg

SEQ ID NO: 65497 - DNA, 15 bp, Artificial Sequence
  dgRNA
  Vmn1r183
cttatcaattggttt

SEQ ID NO: 65498 - DNA, 15 bp, Artificial Sequence
  dgRNA
  Vmn1r183
gcttatcaattggtt

SEQ ID NO: 65499 - DNA, 15 bp, Artificial Sequence
  dgRNA
  Clec1b
gtgtcctggtgcata

SEQ ID NO: 65500 - DNA, 15 bp, Artificial Sequence
  dgRNA
  Clec1b
caccaccgggagaga

SEQ ID NO: 65501 - DNA, 15 bp, Artificial Sequence
  dgRNA
  Clec1b
gcactgagactctaa

SEQ ID NO: 65502 - DNA, 15 bp, Artificial Sequence
  dgRNA
  Clec1b
tctaagggtggacat

SEQ ID NO: 65503 - DNA, 15 bp, Artificial Sequence
  dgRNA
  Havcr1
gcttatggtggcctc

SEQ ID NO: 65504 - DNA, 15 bp, Artificial Sequence
  dgRNA
  Fam227a
accccctaaatacgt

SEQ ID NO: 65505 - DNA, 15 bp, Artificial Sequence
  dgRNA
  Fam227a
ctaaatacgttggtc

SEQ ID NO: 65506 - DNA, 15 bp, Artificial Sequence
  dgRNA
  Fam227a
gttggtctggtcccc

SEQ ID NO: 65507 - DNA, 15 bp, Artificial Sequence
  dgRNA
  Fam227a
agtaatcgttttcct

SEQ ID NO: 65508 - DNA, 15 bp, Artificial Sequence
  dgRNA
  Gda
gggatgaacggtcct

SEQ ID NO: 65509 - DNA, 15 bp, Artificial Sequence
  dgRNA
  Gda
gatttcgataactca

SEQ ID NO: 65510 - DNA, 15 bp, Artificial Sequence
  dgRNA
  Gda
atccaaaaccaacgc

SEQ ID NO: 65511 - DNA, 15 bp, Artificial Sequence
  dgRNA
  Gda
tccaaaaccaacgca

SEQ ID NO: 65512 - DNA, 15 bp, Artificial Sequence
  dgRNA
  Bnc2
tccctctgcccgggg

SEQ ID NO: 65513 - DNA, 15 bp, Artificial Sequence
  dgRNA
  Bnc2
aggagcgggacaact

SEQ ID NO: 65514 - DNA, 15 bp, Artificial Sequence
  dgRNA
  Bnc2
gacaactcggagcgc

SEQ ID NO: 65515 - DNA, 15 bp, Artificial Sequence
  dgRNA
  Bnc2
cggagcgccggctcg

SEQ ID NO: 65516 - DNA, 15 bp, Artificial Sequence
  dgRNA
  Cfl2
ctcgagcgttgaacc

SEQ ID NO: 65517 - DNA, 15 bp, Artificial Sequence
  dgRNA
  Cfl2
gcgttgaacccggat

SEQ ID NO: 65518 - DNA, 15 bp, Artificial Sequence
  dgRNA
  Cfl2
tccctgtcagcatcg

SEQ ID NO: 65519 - DNA, 15 bp, Artificial Sequence
  dgRNA
  Cfl2
gcgtggttctgctag

SEQ ID NO: 65520 - DNA, 15 bp, Artificial Sequence
  dgRNA
  Eif3m
ccgaagctttggccc

SEQ ID NO: 65521 - DNA, 15 bp, Artificial Sequence
  dgRNA
  Eif3m
agctttggcccaggt

SEQ ID NO: 65522 - DNA, 15 bp, Artificial Sequence
  dgRNA
  Eif3m
ggttccgtgacccgc

SEQ ID NO: 65523 - DNA, 15 bp, Artificial Sequence
  dgRNA
  Eif3m
cccacctaagtttcc

SEQ ID NO: 65524 - DNA, 15 bp, Artificial Sequence
  dgRNA
  Taar3
gaatgtactcctggc

SEQ ID NO: 65525 - DNA, 15 bp, Artificial Sequence
  dgRNA
  Myh4
gtgtagcagagcact

SEQ ID NO: 65526 - DNA, 15 bp, Artificial Sequence
  dgRNA
  Myh4
cgggtgctcatgtga

SEQ ID NO: 65527 - DNA, 15 bp, Artificial Sequence
  dgRNA
  Myh4
aactctaagtaatgt

SEQ ID NO: 65528 - DNA, 15 bp, Artificial Sequence
  dgRNA
  Myh4
cggcatccctgagag

SEQ ID NO: 65529 - DNA, 15 bp, Artificial Sequence
  dgRNA
  E330017A01Rik
gaggccttatgtact

SEQ ID NO: 65530 - DNA, 15 bp, Artificial Sequence
  dgRNA
  E330017A01Rik
cttatgtactaggtt

SEQ ID NO: 65531 - DNA, 15 bp, Artificial Sequence
  dgRNA
  E330017A01Rik
taggtttggagtcat

SEQ ID NO: 65532 - DNA, 15 bp, Artificial Sequence
  dgRNA
  E330017A01Rik
aggtttggagtcatg

SEQ ID NO: 65533 - DNA, 15 bp, Artificial Sequence
  dgRNA
  Fap
ctcgagtgatttttg

SEQ ID NO: 65534 - DNA, 15 bp, Artificial Sequence
  dgRNA
  Fap
tggtgtaaatttaca

SEQ ID NO: 65535 - DNA, 15 bp, Artificial Sequence
  dgRNA
  Fap
tcatagttcacttaa

SEQ ID NO: 65536 - DNA, 15 bp, Artificial Sequence
  dgRNA
  Fap
taagttgtcatacag

SEQ ID NO: 65537 - DNA, 15 bp, Artificial Sequence
  dgRNA
  Iglon5
ggccggtgcagccgc

SEQ ID NO: 65538 - DNA, 15 bp, Artificial Sequence
  dgRNA
  Iglon5
cggtgcagccgcagg

SEQ ID NO: 65539 - DNA, 15 bp, Artificial Sequence
  dgRNA
  Iglon5
gtgcagccgcaggcg

SEQ ID NO: 65540 - DNA, 15 bp, Artificial Sequence
  dgRNA
  Iglon5
gggttgctcgttgga

SEQ ID NO: 65541 - DNA, 15 bp, Artificial Sequence
  dgRNA
  Rims1
gcatcatgagagact

SEQ ID NO: 65542 - DNA, 15 bp, Artificial Sequence
  dgRNA
  Rims1
ctgccgccgccggga

SEQ ID NO: 65543 - DNA, 15 bp, Artificial Sequence
  dgRNA
  Rims1
gcttcgctgtgagcg

SEQ ID NO: 65544 - DNA, 15 bp, Artificial Sequence
  dgRNA
  Rims1
gtgagcgtggaaagc

SEQ ID NO: 65545 - DNA, 15 bp, Artificial Sequence
  dgRNA
  Ppp1r16a
caaccaatcagctac

SEQ ID NO: 65546 - DNA, 15 bp, Artificial Sequence
  dgRNA
  Ppp1r16a
tggaggacgctcctt

SEQ ID NO: 65547 - DNA, 15 bp, Artificial Sequence
  dgRNA
  Ppp1r16a
acaccctgatgtccg

SEQ ID NO: 65548 - DNA, 15 bp, Artificial Sequence
  dgRNA
  Ppp1r16a
aacaccctgatgtcc

SEQ ID NO: 65549 - DNA, 15 bp, Artificial Sequence
  dgRNA
  Kcnj12
tattagcgaaacctg

SEQ ID NO: 65550 - DNA, 15 bp, Artificial Sequence
  dgRNA
  Kcnj12
tcctgctccatccgg

SEQ ID NO: 65551 - DNA, 15 bp, Artificial Sequence
  dgRNA
  Kcnj12
gctccaccctaggtt

SEQ ID NO: 65552 - DNA, 15 bp, Artificial Sequence
  dgRNA
  Kcnj12
ccaccctaggttagg

SEQ ID NO: 65553 - DNA, 15 bp, Artificial Sequence
  dgRNA
  Fgf11
gagcggccccaaaat

SEQ ID NO: 65554 - DNA, 15 bp, Artificial Sequence
  dgRNA
  Fgf11
agcggccccaaaata

SEQ ID NO: 65555 - DNA, 15 bp, Artificial Sequence
  dgRNA
  Fgf11
tagaaagaagcctcg

SEQ ID NO: 65556 - DNA, 15 bp, Artificial Sequence
  dgRNA
  Fgf11
gagggtcttgactgt

SEQ ID NO: 65557 - DNA, 15 bp, Artificial Sequence
  dgRNA
  Igfbpl1
taaaataaggcgtcc

SEQ ID NO: 65558 - DNA, 15 bp, Artificial Sequence
  dgRNA
  Igfbpl1
aataaggcgtcctgg

SEQ ID NO: 65559 - DNA, 15 bp, Artificial Sequence
  dgRNA
  Igfbpl1
ataaggcgtcctggt

SEQ ID NO: 65560 - DNA, 15 bp, Artificial Sequence
  dgRNA
  Igfbpl1
agacaagttgccgtt

SEQ ID NO: 65561 - DNA, 15 bp, Artificial Sequence
  dgRNA
  Tspan4
cggcgtctggcgtgc

SEQ ID NO: 65562 - DNA, 15 bp, Artificial Sequence
  dgRNA
  Tspan4
ggcagtagcttttca

SEQ ID NO: 65563 - DNA, 15 bp, Artificial Sequence
  dgRNA
  Tspan4
ggcgcgcccatagcg

SEQ ID NO: 65564 - DNA, 15 bp, Artificial Sequence
  dgRNA
  Tspan4
gcgcgcccatagcgc

SEQ ID NO: 65565 - DNA, 15 bp, Artificial Sequence
  dgRNA
  S100a11
gacctgttgagtcac

SEQ ID NO: 65566 - DNA, 15 bp, Artificial Sequence
  dgRNA
  S100a11
tctagagcaccgaca

SEQ ID NO: 65567 - DNA, 15 bp, Artificial Sequence
  dgRNA
  S100a11
ctagagcaccgacat

SEQ ID NO: 65568 - DNA, 15 bp, Artificial Sequence
  dgRNA
  S100a11
tagagcaccgacatg

SEQ ID NO: 65569 - DNA, 15 bp, Artificial Sequence
  dgRNA
  Zfp507
ttctgccagagggcg

SEQ ID NO: 65570 - DNA, 15 bp, Artificial Sequence
  dgRNA
  Zfp507
acgccgcgcgcctcc

SEQ ID NO: 65571 - DNA, 15 bp, Artificial Sequence
  dgRNA
  Zfp507
gtggcctcaacctgc

SEQ ID NO: 65572 - DNA, 15 bp, Artificial Sequence
  dgRNA
  Zfp507
agttgatatccactg

SEQ ID NO: 65573 - DNA, 15 bp, Artificial Sequence
  dgRNA
  Zc2hc1a
ggagagtccctcggg

SEQ ID NO: 65574 - DNA, 15 bp, Artificial Sequence
  dgRNA
  Zc2hc1a
gagtccctcgggagg

SEQ ID NO: 65575 - DNA, 15 bp, Artificial Sequence
  dgRNA
  Zc2hc1a
cccgcgcggaccaat

SEQ ID NO: 65576 - DNA, 15 bp, Artificial Sequence
  dgRNA
  Zc2hc1a
gcgcggaccaatagg

SEQ ID NO: 65577 - DNA, 15 bp, Artificial Sequence
  dgRNA
  Tmem229a
accacagtttgggcc

SEQ ID NO: 65578 - DNA, 15 bp, Artificial Sequence
  dgRNA
  Tmem229a
gtttgggcccgggcc

SEQ ID NO: 65579 - DNA, 15 bp, Artificial Sequence
  dgRNA
  Tmem229a
ccggcctccggctag

SEQ ID NO: 65580 - DNA, 15 bp, Artificial Sequence
  dgRNA
  Tmem229a
ccggctagtggcacc

SEQ ID NO: 65581 - DNA, 15 bp, Artificial Sequence
  dgRNA
  Ndufb11
taagggagcgcgctc

SEQ ID NO: 65582 - DNA, 15 bp, Artificial Sequence
  dgRNA
  Ndufb11
ggagcgcgctctggc

SEQ ID NO: 65583 - DNA, 15 bp, Artificial Sequence
  dgRNA
  Ndufb11
ttggctacccctaag

SEQ ID NO: 65584 - DNA, 15 bp, Artificial Sequence
  dgRNA
  Ndufb11
tggtggtcggatcgc

SEQ ID NO: 65585 - DNA, 15 bp, Artificial Sequence
  dgRNA
  DHRSX
cgcccatctcccctc

SEQ ID NO: 65586 - DNA, 15 bp, Artificial Sequence
  dgRNA
  DHRSX
atctcccctcaggtc

SEQ ID NO: 65587 - DNA, 15 bp, Artificial Sequence
  dgRNA
  DHRSX
ctcaggtcaggctcg

SEQ ID NO: 65588 - DNA, 15 bp, Artificial Sequence
  dgRNA
  DHRSX
cccgccccttcacac

SEQ ID NO: 65589 - DNA, 15 bp, Artificial Sequence
  dgRNA
  Nhlrc2
aaagagtctcctccg

SEQ ID NO: 65590 - DNA, 15 bp, Artificial Sequence
  dgRNA
  Nhlrc2
aagagtctcctccga

SEQ ID NO: 65591 - DNA, 15 bp, Artificial Sequence
  dgRNA
  Nhlrc2
tcgagtctttcttgg

SEQ ID NO: 65592 - DNA, 15 bp, Artificial Sequence
  dgRNA
  Nhlrc2
cgagtctttcttggc

SEQ ID NO: 65593 - DNA, 15 bp, Artificial Sequence
  dgRNA
  Ccnb1
cgccatgcctaccta

SEQ ID NO: 65594 - DNA, 15 bp, Artificial Sequence
  dgRNA
  Ccnb1
atgcctacctaaggc

SEQ ID NO: 65595 - DNA, 15 bp, Artificial Sequence
  dgRNA
  Ccnb1
atgcgacttgtgcgc

SEQ ID NO: 65596 - DNA, 15 bp, Artificial Sequence
  dgRNA
  Ccnb1
gagcctgacctcgcg

SEQ ID NO: 65597 - DNA, 15 bp, Artificial Sequence
  dgRNA
  Tmc2
tacaactgactactc

SEQ ID NO: 65598 - DNA, 15 bp, Artificial Sequence
  dgRNA
  Tmc2
ctatcgcattctcgt

SEQ ID NO: 65599 - DNA, 15 bp, Artificial Sequence
  dgRNA
  Tmc2
ggctagctaatgggg

SEQ ID NO: 65600 - DNA, 15 bp, Artificial Sequence
  dgRNA
  Tmc2
gatggctagctaatg

SEQ ID NO: 65601 - DNA, 15 bp, Artificial Sequence
  dgRNA
  Rab19
tatggaggcatcttg

SEQ ID NO: 65602 - DNA, 15 bp, Artificial Sequence
  dgRNA
  Rab19
tcttcctttaagtcg

SEQ ID NO: 65603 - DNA, 15 bp, Artificial Sequence
  dgRNA
  Rab19
gcccagccaaacaag

SEQ ID NO: 65604 - DNA, 15 bp, Artificial Sequence
  dgRNA
  Rab19
ccaaacaagcggatc

SEQ ID NO: 65605 - DNA, 15 bp, Artificial Sequence
  dgRNA
  Best1
accctatgcagaacc

SEQ ID NO: 65606 - DNA, 15 bp, Artificial Sequence
  dgRNA
  Best1
tccaggttctgcata

SEQ ID NO: 65607 - DNA, 15 bp, Artificial Sequence
  dgRNA
  Best1
gtaagcagtaggccc

SEQ ID NO: 65608 - DNA, 15 bp, Artificial Sequence
  dgRNA
  Apc2
atcaaatagcctccc

SEQ ID NO: 65609 - DNA, 15 bp, Artificial Sequence
  dgRNA
  Apc2
actattcctgcctcg

SEQ ID NO: 65610 - DNA, 15 bp, Artificial Sequence
  dgRNA
  Apc2
ctcgagggcacaccc

SEQ ID NO: 65611 - DNA, 15 bp, Artificial Sequence
  dgRNA
  Apc2
gggcacacccaggat

SEQ ID NO: 65612 - DNA, 15 bp, Artificial Sequence
  dgRNA
  Ensa
actctctttcccggt

SEQ ID NO: 65613 - DNA, 15 bp, Artificial Sequence
  dgRNA
  Ensa
gaatccgcccacctc

SEQ ID NO: 65614 - DNA, 15 bp, Artificial Sequence
  dgRNA
  Ensa
ccggccaacgcttat

SEQ ID NO: 65615 - DNA, 15 bp, Artificial Sequence
  dgRNA
  Ensa
attggctctcatagg

SEQ ID NO: 65616 - DNA, 15 bp, Artificial Sequence
  dgRNA
  Rhox1
gacttacctgccacc

SEQ ID NO: 65617 - DNA, 15 bp, Artificial Sequence
  dgRNA
  Rhox1
aatggcccaggtggc

SEQ ID NO: 65618 - DNA, 15 bp, Artificial Sequence
  dgRNA
  Rhox1
gggtaatggcccagg

SEQ ID NO: 65619 - DNA, 15 bp, Artificial Sequence
  dgRNA
  Rhox1
ctagggtaatggccc

SEQ ID NO: 65620 - DNA, 15 bp, Artificial Sequence
  dgRNA
  Otud5
tgtctgcagtcgtcc

SEQ ID NO: 65621 - DNA, 15 bp, Artificial Sequence
  dgRNA
  Otud5
ctgcagtcgtcccgg

SEQ ID NO: 65622 - DNA, 15 bp, Artificial Sequence
  dgRNA
  Otud5
tgcagtcgtcccggc

SEQ ID NO: 65623 - DNA, 15 bp, Artificial Sequence
  dgRNA
  Otud5
cacgtacttccgtgc

SEQ ID NO: 65624 - DNA, 15 bp, Artificial Sequence
  dgRNA
  Enpp2
cggataaagtacatt

SEQ ID NO: 65625 - DNA, 15 bp, Artificial Sequence
  dgRNA
  Enpp2
aacatgcactgttat

SEQ ID NO: 65626 - DNA, 15 bp, Artificial Sequence
  dgRNA
  Kdm4c
aagaggcggaagtct

SEQ ID NO: 65627 - DNA, 15 bp, Artificial Sequence
  dgRNA
  Kdm4c
gtctcggcttcaagt

SEQ ID NO: 65628 - DNA, 15 bp, Artificial Sequence
  dgRNA
  Kdm4c
tctcggcttcaagtc

SEQ ID NO: 65629 - DNA, 15 bp, Artificial Sequence
  dgRNA
  Kdm4c
gagcgcccggcccag

SEQ ID NO: 65630 - DNA, 15 bp, Artificial Sequence
  dgRNA
  Sgip1
ggggtagcgagcaat

SEQ ID NO: 65631 - DNA, 15 bp, Artificial Sequence
  dgRNA
  Sgip1
gggtagcgagcaatg

SEQ ID NO: 65632 - DNA, 15 bp, Artificial Sequence
  dgRNA
  Sgip1
gcgagcaatggggac

SEQ ID NO: 65633 - DNA, 15 bp, Artificial Sequence
  dgRNA
  Sgip1
gttccgtgcgctctc

SEQ ID NO: 65634 - DNA, 15 bp, Artificial Sequence
  dgRNA
  Serpinb9c
ggtagagttagatgg

SEQ ID NO: 65635 - DNA, 15 bp, Artificial Sequence
  dgRNA
  Serpinb9c
gcccgaggcaagagg

SEQ ID NO: 65636 - DNA, 15 bp, Artificial Sequence
  dgRNA
  Slc1a7
caataccatgcatct

SEQ ID NO: 65637 - DNA, 15 bp, Artificial Sequence
  dgRNA
  Slc1a7
ccactagcactactg

SEQ ID NO: 65638 - DNA, 15 bp, Artificial Sequence
  dgRNA
  Slc1a7
ctagcactactgagg

SEQ ID NO: 65639 - DNA, 15 bp, Artificial Sequence
  dgRNA
  Slc1a7
tagcactactgaggt

SEQ ID NO: 65640 - DNA, 15 bp, Artificial Sequence
  dgRNA
  Rit2
aacaagcgagatcag

SEQ ID NO: 65641 - DNA, 15 bp, Artificial Sequence
  dgRNA
  Rit2
gcagcagaagcgttt

SEQ ID NO: 65642 - DNA, 15 bp, Artificial Sequence
  dgRNA
  Rit2
ctcgcttgttcattc

SEQ ID NO: 65643 - DNA, 15 bp, Artificial Sequence
  dgRNA
  Eaf2
caaagacggagccaa

SEQ ID NO: 65644 - DNA, 15 bp, Artificial Sequence
  dgRNA
  Eaf2
ctaagaaggacgtgc

SEQ ID NO: 65645 - DNA, 15 bp, Artificial Sequence
  dgRNA
  Eaf2
taagaaggacgtgcc

SEQ ID NO: 65646 - DNA, 15 bp, Artificial Sequence
  dgRNA
  Eaf2
gaaggacgtgccggg

SEQ ID NO: 65647 - DNA, 15 bp, Artificial Sequence
  dgRNA
  Olfr479
aggttgaacttacat

SEQ ID NO: 65648 - DNA, 15 bp, Artificial Sequence
  dgRNA
  Olfr479
ggttgaacttacatt

SEQ ID NO: 65649 - DNA, 15 bp, Artificial Sequence
  dgRNA
  Olfr479
tacattgggcttagc

SEQ ID NO: 65650 - DNA, 15 bp, Artificial Sequence
  dgRNA
  Olfr479
agttactgacagcat

SEQ ID NO: 65651 - DNA, 15 bp, Artificial Sequence
  dgRNA
  Cops7a
cccgcctcccgagag

SEQ ID NO: 65652 - DNA, 15 bp, Artificial Sequence
  dgRNA
  Cops7a
ccgagagcggaagta

SEQ ID NO: 65653 - DNA, 15 bp, Artificial Sequence
  dgRNA
  Cops7a
gagcggaagtacggc

SEQ ID NO: 65654 - DNA, 15 bp, Artificial Sequence
  dgRNA
  Cops7a
agtacggccggaagc

SEQ ID NO: 65655 - DNA, 15 bp, Artificial Sequence
  dgRNA
  Il22ra1
gtctgcacccaagaa

SEQ ID NO: 65656 - DNA, 15 bp, Artificial Sequence
  dgRNA
  Il22ra1
ccttggatctcgccc

SEQ ID NO: 65657 - DNA, 15 bp, Artificial Sequence
  dgRNA
  Il22ra1
atctcgcccaggtcc

SEQ ID NO: 65658 - DNA, 15 bp, Artificial Sequence
  dgRNA
  Il22ra1
cctcagcacccgact

SEQ ID NO: 65659 - DNA, 15 bp, Artificial Sequence
  dgRNA
  Pfdn4
cagcgctccccctgc

SEQ ID NO: 65660 - DNA, 15 bp, Artificial Sequence
  dgRNA
  Pfdn4
tccccctgctggccg

SEQ ID NO: 65661 - DNA, 15 bp, Artificial Sequence
  dgRNA
  Pfdn4
cgtggctgggatctc

SEQ ID NO: 65662 - DNA, 15 bp, Artificial Sequence
  dgRNA
  Pfdn4
ctcgggcccgactat

SEQ ID NO: 65663 - DNA, 15 bp, Artificial Sequence
  dgRNA
  Zfp819
aagcgatagggtata

SEQ ID NO: 65664 - DNA, 15 bp, Artificial Sequence
  dgRNA
  Zfp819
agcgatagggtatat

SEQ ID NO: 65665 - DNA, 15 bp, Artificial Sequence
  dgRNA
  Zfp819
tttccgccagaaaag

SEQ ID NO: 65666 - DNA, 15 bp, Artificial Sequence
  dgRNA
  Zfp819
gcttagatcgtcacg

SEQ ID NO: 65667 - DNA, 15 bp, Artificial Sequence
  dgRNA
  Gata6
ctcgctcctactctg

SEQ ID NO: 65668 - DNA, 15 bp, Artificial Sequence
  dgRNA
  Gata6
tcaacccacgcccgc

SEQ ID NO: 65669 - DNA, 15 bp, Artificial Sequence
  dgRNA
  Gata6
ctcttattgtccgct

SEQ ID NO: 65670 - DNA, 15 bp, Artificial Sequence
  dgRNA
  Gata6
tcttattgtccgcta

SEQ ID NO: 65671 - DNA, 15 bp, Artificial Sequence
  dgRNA
  Fam13a
gagcccaatcctgca

SEQ ID NO: 65672 - DNA, 15 bp, Artificial Sequence
  dgRNA
  Fam13a
tgctcgctgcttagt

SEQ ID NO: 65673 - DNA, 15 bp, Artificial Sequence
  dgRNA
  4833427G06Rik
cattattgggctatc

SEQ ID NO: 65674 - DNA, 15 bp, Artificial Sequence
  dgRNA
  4833427G06Rik
attattgggctatct

SEQ ID NO: 65675 - DNA, 15 bp, Artificial Sequence
  dgRNA
  4833427G06Rik
ttattgggctatctg

SEQ ID NO: 65676 - DNA, 15 bp, Artificial Sequence
  dgRNA
  4833427G06Rik
tattgggctatctgg

SEQ ID NO: 65677 - DNA, 15 bp, Artificial Sequence
  dgRNA
  Trmt10c
gtggcagggcatcgg

SEQ ID NO: 65678 - DNA, 15 bp, Artificial Sequence
  dgRNA
  Trmt10c
caaaacgtcattttc

SEQ ID NO: 65679 - DNA, 15 bp, Artificial Sequence
  dgRNA
  Trmt10c
aaaacgtcattttcc

SEQ ID NO: 65680 - DNA, 15 bp, Artificial Sequence
  dgRNA
  Trmt10c
aaacgtcattttccg

SEQ ID NO: 65681 - DNA, 15 bp, Artificial Sequence
  dgRNA
  Tm6sf1
ttgatcaaggtcaag

SEQ ID NO: 65682 - DNA, 15 bp, Artificial Sequence
  dgRNA
  Tm6sf1
agtgagcaaccaagg

SEQ ID NO: 65683 - DNA, 15 bp, Artificial Sequence
  dgRNA
  Tm6sf1
ctggaacattggttg

SEQ ID NO: 65684 - DNA, 15 bp, Artificial Sequence
  dgRNA
  Tm6sf1
ggttgcggacgttga

SEQ ID NO: 65685 - DNA, 15 bp, Artificial Sequence
  dgRNA
  Npr3
ctagggacattgtag

SEQ ID NO: 65686 - DNA, 15 bp, Artificial Sequence
  dgRNA
  Npr3
ttggcgagttactga

SEQ ID NO: 65687 - DNA, 15 bp, Artificial Sequence
  dgRNA
  Npr3
tggcgagttactgaa

SEQ ID NO: 65688 - DNA, 15 bp, Artificial Sequence
  dgRNA
  Npr3
ggcgagttactgaag

SEQ ID NO: 65689 - DNA, 15 bp, Artificial Sequence
  dgRNA
  Myh7b
gtgatcccctgacaa

SEQ ID NO: 65690 - DNA, 15 bp, Artificial Sequence
  dgRNA
  Myh7b
tgatcccctgacaat

SEQ ID NO: 65691 - DNA, 15 bp, Artificial Sequence
  dgRNA
  Myh7b
tcccctgacaatggg

SEQ ID NO: 65692 - DNA, 15 bp, Artificial Sequence
  dgRNA
  Myh7b
caggggttgagctag

SEQ ID NO: 65693 - DNA, 15 bp, Artificial Sequence
  dgRNA
  Col16a1
acccgcaggctcacc

SEQ ID NO: 65694 - DNA, 15 bp, Artificial Sequence
  dgRNA
  Col16a1
ggaagcgggacgggc

SEQ ID NO: 65695 - DNA, 15 bp, Artificial Sequence
  dgRNA
  Col16a1
cgggacgggcgggcc

SEQ ID NO: 65696 - DNA, 15 bp, Artificial Sequence
  dgRNA
  Col16a1
gcgggcccgggcgca

SEQ ID NO: 65697 - DNA, 15 bp, Artificial Sequence
  dgRNA
  Brinp3
tactgctgttgcgca

SEQ ID NO: 65698 - DNA, 15 bp, Artificial Sequence
  dgRNA
  Brinp3
actgctgttgcgcaa

SEQ ID NO: 65699 - DNA, 15 bp, Artificial Sequence
  dgRNA
  Brinp3
gctgttgcgcaaggg

SEQ ID NO: 65700 - DNA, 15 bp, Artificial Sequence
  dgRNA
  Brinp3
gttgcgcaagggtgg

SEQ ID NO: 65701 - DNA, 15 bp, Artificial Sequence
  dgRNA
  Krtap19-5
tcgacagtgacacaa

SEQ ID NO: 65702 - DNA, 15 bp, Artificial Sequence
  dgRNA
  Krtap19-5
cagtgacacaacgga

SEQ ID NO: 65703 - DNA, 15 bp, Artificial Sequence
  dgRNA
  Krtap19-5
agtgacacaacggaa

SEQ ID NO: 65704 - DNA, 15 bp, Artificial Sequence
  dgRNA
  Krtap19-5
tatatgtactctggc

SEQ ID NO: 65705 - DNA, 15 bp, Artificial Sequence
  dgRNA
  Lig3
tgtcttccgcaccgc

SEQ ID NO: 65706 - DNA, 15 bp, Artificial Sequence
  dgRNA
  Lig3
agtgatcctagggat

SEQ ID NO: 65707 - DNA, 15 bp, Artificial Sequence
  dgRNA
  Lig3
attgcagtgatccta

SEQ ID NO: 65708 - DNA, 15 bp, Artificial Sequence
  dgRNA
  Ppp1r1b
gggcaaagcatgtct

SEQ ID NO: 65709 - DNA, 15 bp, Artificial Sequence
  dgRNA
  Ppp1r1b
ggcctaagcagcctt

SEQ ID NO: 65710 - DNA, 15 bp, Artificial Sequence
  dgRNA
  Ppp1r1b
ccagcctcaattacc

SEQ ID NO: 65711 - DNA, 15 bp, Artificial Sequence
  dgRNA
  Ppp1r1b
ttccctggagcgtca

SEQ ID NO: 65712 - DNA, 15 bp, Artificial Sequence
  dgRNA
  Zfp629
cccgcctcggtcctc

SEQ ID NO: 65713 - DNA, 15 bp, Artificial Sequence
  dgRNA
  Zfp629
ccgcctcggtcctct

SEQ ID NO: 65714 - DNA, 15 bp, Artificial Sequence
  dgRNA
  Zfp629
cgcctcggtcctctg

SEQ ID NO: 65715 - DNA, 15 bp, Artificial Sequence
  dgRNA
  Zfp629
ctctgggggtcgtcc

SEQ ID NO: 65716 - DNA, 15 bp, Artificial Sequence
  dgRNA
  Rp2
gcagagcagcttgcg

SEQ ID NO: 65717 - DNA, 15 bp, Artificial Sequence
  dgRNA
  Rp2
ttgcgaggcattgat

SEQ ID NO: 65718 - DNA, 15 bp, Artificial Sequence
  dgRNA
  Rp2
ctgctgcccgcttat

SEQ ID NO: 65719 - DNA, 15 bp, Artificial Sequence
  dgRNA
  Rp2
cttattggttgccat

SEQ ID NO: 65720 - DNA, 15 bp, Artificial Sequence
  dgRNA
  Parp8
tgtgcgcgcgtgagt

SEQ ID NO: 65721 - DNA, 15 bp, Artificial Sequence
  dgRNA
  Parp8
gcgcgtgagtcggag

SEQ ID NO: 65722 - DNA, 15 bp, Artificial Sequence
  dgRNA
  Parp8
cgcgtgagtcggagc

SEQ ID NO: 65723 - DNA, 15 bp, Artificial Sequence
  dgRNA
  Parp8
gcgtgagtcggagcg

SEQ ID NO: 65724 - DNA, 15 bp, Artificial Sequence
  dgRNA
  Tceb3
aaacgagcgtatgac

SEQ ID NO: 65725 - DNA, 15 bp, Artificial Sequence
  dgRNA
  Tceb3
agcgtatgactggaa

SEQ ID NO: 65726 - DNA, 15 bp, Artificial Sequence
  dgRNA
  Tceb3
gcgtggctggttgcg

SEQ ID NO: 65727 - DNA, 15 bp, Artificial Sequence
  dgRNA
  Tceb3
ctggttgcgtggctc

SEQ ID NO: 65728 - DNA, 15 bp, Artificial Sequence
  dgRNA
  Hdhd1a
acacatgcgtgttgt

SEQ ID NO: 65729 - DNA, 15 bp, Artificial Sequence
  dgRNA
  Tor1aip1
agtcacctaattatg

SEQ ID NO: 65730 - DNA, 15 bp, Artificial Sequence
  dgRNA
  Tor1aip1
ggttagagtcacagt

SEQ ID NO: 65731 - DNA, 15 bp, Artificial Sequence
  dgRNA
  Tor1aip1
tagtacacaccctgt

SEQ ID NO: 65732 - DNA, 15 bp, Artificial Sequence
  dgRNA
  Tor1aip1
ttatatccgagtgca

SEQ ID NO: 65733 - DNA, 15 bp, Artificial Sequence
  dgRNA
  Ythdc2
catgttactatactc

SEQ ID NO: 65734 - DNA, 15 bp, Artificial Sequence
  dgRNA
  Ythdc2
tagtggaagcaattc

SEQ ID NO: 65735 - DNA, 15 bp, Artificial Sequence
  dgRNA
  Ythdc2
agattaatattagta

SEQ ID NO: 65736 - DNA, 15 bp, Artificial Sequence
  dgRNA
  Ythdc2
ctctatttgagccaa

SEQ ID NO: 65737 - DNA, 15 bp, Artificial Sequence
  dgRNA
  Slc9c1
cagtaggcacatagc

SEQ ID NO: 65738 - DNA, 15 bp, Artificial Sequence
  dgRNA
  Slc9c1
agtaggcacatagca

SEQ ID NO: 65739 - DNA, 15 bp, Artificial Sequence
  dgRNA
  Slc9c1
gtaggcacatagcag

SEQ ID NO: 65740 - DNA, 15 bp, Artificial Sequence
  dgRNA
  Slc9c1
cacatagcaggggcg

SEQ ID NO: 65741 - DNA, 15 bp, Artificial Sequence
  dgRNA
  Sp6
ccaagtggttcttgt

SEQ ID NO: 65742 - DNA, 15 bp, Artificial Sequence
  dgRNA
  Brf2
acccgagtccacaga

SEQ ID NO: 65743 - DNA, 15 bp, Artificial Sequence
  dgRNA
  Brf2
agtggcgtactgccg

SEQ ID NO: 65744 - DNA, 15 bp, Artificial Sequence
  dgRNA
  Brf2
gtggcgtactgccga

SEQ ID NO: 65745 - DNA, 15 bp, Artificial Sequence
  dgRNA
  Brf2
tggcgtactgccgag

SEQ ID NO: 65746 - DNA, 15 bp, Artificial Sequence
  dgRNA
  H2afz
caccgtccactcgct

SEQ ID NO: 65747 - DNA, 15 bp, Artificial Sequence
  dgRNA
  H2afz
cgtccactcgctcgg

SEQ ID NO: 65748 - DNA, 15 bp, Artificial Sequence
  dgRNA
  H2afz
gctgccctcccgccg

SEQ ID NO: 65749 - DNA, 15 bp, Artificial Sequence
  dgRNA
  H2afz
tgtgcgttctcccat

SEQ ID NO: 65750 - DNA, 15 bp, Artificial Sequence
  dgRNA
  Thbs1
gctcctgtgcgggat

SEQ ID NO: 65751 - DNA, 15 bp, Artificial Sequence
  dgRNA
  Thbs1
tgtgcgccaagcagc

SEQ ID NO: 65752 - DNA, 15 bp, Artificial Sequence
  dgRNA
  Thbs1
gtgcgccaagcagca

SEQ ID NO: 65753 - DNA, 15 bp, Artificial Sequence
  dgRNA
  Thbs1
tgcgccaagcagcag

SEQ ID NO: 65754 - DNA, 15 bp, Artificial Sequence
  dgRNA
  Lxn
cagaaggacccatcg

SEQ ID NO: 65755 - DNA, 15 bp, Artificial Sequence
  dgRNA
  Lxn
ggacccatcgaggca

SEQ ID NO: 65756 - DNA, 15 bp, Artificial Sequence
  dgRNA
  Lxn
acctgcccagacccg

SEQ ID NO: 65757 - DNA, 15 bp, Artificial Sequence
  dgRNA
  Lxn
cctgcccagacccgc

SEQ ID NO: 65758 - DNA, 15 bp, Artificial Sequence
  dgRNA
  Tob1
cgtctggacgtgggc

SEQ ID NO: 65759 - DNA, 15 bp, Artificial Sequence
  dgRNA
  Tob1
tggacgtgggcaggc

SEQ ID NO: 65760 - DNA, 15 bp, Artificial Sequence
  dgRNA
  Tob1
gcgggacttggccaa

SEQ ID NO: 65761 - DNA, 15 bp, Artificial Sequence
  dgRNA
  Tob1
cttggccaatggcgt

SEQ ID NO: 65762 - DNA, 15 bp, Artificial Sequence
  dgRNA
  Clec9a
gcatctgatactatg

SEQ ID NO: 65763 - DNA, 15 bp, Artificial Sequence
  dgRNA
  Clec9a
catagtatcagatgc

SEQ ID NO: 65764 - DNA, 15 bp, Artificial Sequence
  dgRNA
  Rab3gap2
agaaagaatgcggcc

SEQ ID NO: 65765 - DNA, 15 bp, Artificial Sequence
  dgRNA
  Rab3gap2
ccctcggctcccgct

SEQ ID NO: 65766 - DNA, 15 bp, Artificial Sequence
  dgRNA
  Rab3gap2
gcgcacgcgcagctt

SEQ ID NO: 65767 - DNA, 15 bp, Artificial Sequence
  dgRNA
  Rab3gap2
gcacgcgcagcttcg

SEQ ID NO: 65768 - DNA, 15 bp, Artificial Sequence
  dgRNA
  Lats2
atcaccatgcgtttc

SEQ ID NO: 65769 - DNA, 15 bp, Artificial Sequence
  dgRNA
  Lats2
aacgcatggtgattt

SEQ ID NO: 65770 - DNA, 15 bp, Artificial Sequence
  dgRNA
  Arsk
cgatcagaacccacc

SEQ ID NO: 65771 - DNA, 15 bp, Artificial Sequence
  dgRNA
  Arsk
catcgcttgagtgag

SEQ ID NO: 65772 - DNA, 15 bp, Artificial Sequence
  dgRNA
  Arsk
aaacggtcttcacat

SEQ ID NO: 65773 - DNA, 15 bp, Artificial Sequence
  dgRNA
  Arsk
tgggctgagcgcgat

SEQ ID NO: 65774 - DNA, 15 bp, Artificial Sequence
  dgRNA
  Wbp11
caatactctggaatg

SEQ ID NO: 65775 - DNA, 15 bp, Artificial Sequence
  dgRNA
  Wbp11
atgaggcgggtctct

SEQ ID NO: 65776 - DNA, 15 bp, Artificial Sequence
  dgRNA
  Wbp11
ctatagttatccaat

SEQ ID NO: 65777 - DNA, 15 bp, Artificial Sequence
  dgRNA
  Wbp11
gagcggaagtacctc

SEQ ID NO: 65778 - DNA, 15 bp, Artificial Sequence
  dgRNA
  Krt34
ctccacccactggta

SEQ ID NO: 65779 - DNA, 15 bp, Artificial Sequence
  dgRNA
  Krt34
tccacccactggtat

SEQ ID NO: 65780 - DNA, 15 bp, Artificial Sequence
  dgRNA
  Krt34
ataaaaagaccacga

SEQ ID NO: 65781 - DNA, 15 bp, Artificial Sequence
  dgRNA
  Krt34
cataccagtgggtgg

SEQ ID NO: 65782 - DNA, 15 bp, Artificial Sequence
  dgRNA
  Mep1a
actacgcgtactaag

SEQ ID NO: 65783 - DNA, 15 bp, Artificial Sequence
  dgRNA
  Mep1a
gctctaaaagagact

SEQ ID NO: 65784 - DNA, 15 bp, Artificial Sequence
  dgRNA
  Mep1a
gaatgacacttttgt

SEQ ID NO: 65785 - DNA, 15 bp, Artificial Sequence
  dgRNA
  Mep1a
ttgctctcactgtcg

SEQ ID NO: 65786 - DNA, 15 bp, Artificial Sequence
  dgRNA
  Rnf126
ccctcacctccgtcc

SEQ ID NO: 65787 - DNA, 15 bp, Artificial Sequence
  dgRNA
  Rnf126
ccgtcccggttacta

SEQ ID NO: 65788 - DNA, 15 bp, Artificial Sequence
  dgRNA
  Rnf126
cgccgcttcgccccc

SEQ ID NO: 65789 - DNA, 15 bp, Artificial Sequence
  dgRNA
  Rnf126
ccgggacggaggtga

SEQ ID NO: 65790 - DNA, 15 bp, Artificial Sequence
  dgRNA
  Cyct
cactgtaagtgtaca

SEQ ID NO: 65791 - DNA, 15 bp, Artificial Sequence
  dgRNA
  Cyct
gagttaaagagtcgg

SEQ ID NO: 65792 - DNA, 15 bp, Artificial Sequence
  dgRNA
  Cyct
agcctctgcgagagt

SEQ ID NO: 65793 - DNA, 15 bp, Artificial Sequence
  dgRNA
  Cyct
gcctctgcgagagtt

SEQ ID NO: 65794 - DNA, 15 bp, Artificial Sequence
  dgRNA
  Rab8b
gttgttcggacagtt

SEQ ID NO: 65795 - DNA, 15 bp, Artificial Sequence
  dgRNA
  Rab8b
ttgttcggacagttt

SEQ ID NO: 65796 - DNA, 15 bp, Artificial Sequence
  dgRNA
  Rab8b
cggacagtttgggcg

SEQ ID NO: 65797 - DNA, 15 bp, Artificial Sequence
  dgRNA
  Rab8b
ggcgaggcacgcccg

SEQ ID NO: 65798 - DNA, 15 bp, Artificial Sequence
  dgRNA
  Clec12b
gagttgttgaggcat

SEQ ID NO: 65799 - DNA, 15 bp, Artificial Sequence
  dgRNA
  Clec12b
atagaactagtaatg

SEQ ID NO: 65800 - DNA, 15 bp, Artificial Sequence
  dgRNA
  Fgfr4
ctctgaaggtcgctc

SEQ ID NO: 65801 - DNA, 15 bp, Artificial Sequence
  dgRNA
  Fgfr4
aggtcgctcaggcca

SEQ ID NO: 65802 - DNA, 15 bp, Artificial Sequence
  dgRNA
  Fgfr4
gtgagtgccaaattg

SEQ ID NO: 65803 - DNA, 15 bp, Artificial Sequence
  dgRNA
  Fgfr4
caagttagaccttgc

SEQ ID NO: 65804 - DNA, 15 bp, Artificial Sequence
  dgRNA
  Noto
gggatgcaacctgcc

SEQ ID NO: 65805 - DNA, 15 bp, Artificial Sequence
  dgRNA
  Noto
agcgatgattaagtc

SEQ ID NO: 65806 - DNA, 15 bp, Artificial Sequence
  dgRNA
  Noto
tcgctgattgaggcc

SEQ ID NO: 65807 - DNA, 15 bp, Artificial Sequence
  dgRNA
  Noto
aatcatcgctgattg

SEQ ID NO: 65808 - DNA, 15 bp, Artificial Sequence
  dgRNA
  Epas1
gccggtgtacagctc

SEQ ID NO: 65809 - DNA, 15 bp, Artificial Sequence
  dgRNA
  Epas1
cggccgtacaatcct

SEQ ID NO: 65810 - DNA, 15 bp, Artificial Sequence
  dgRNA
  Epas1
gtatggtcatctcag

SEQ ID NO: 65811 - DNA, 15 bp, Artificial Sequence
  dgRNA
  Epas1
gcactcgcttgcccc

SEQ ID NO: 65812 - DNA, 15 bp, Artificial Sequence
  dgRNA
  Ddc
gggagccgaagctct

SEQ ID NO: 65813 - DNA, 15 bp, Artificial Sequence
  dgRNA
  Ddc
ctgattggcttcggg

SEQ ID NO: 65814 - DNA, 15 bp, Artificial Sequence
  dgRNA
  Ddc
attggcttcgggagg

SEQ ID NO: 65815 - DNA, 15 bp, Artificial Sequence
  dgRNA
  Iqgap3
caccaaatagcacac

SEQ ID NO: 65816 - DNA, 15 bp, Artificial Sequence
  dgRNA
  Iqgap3
gcccaggaattctat

SEQ ID NO: 65817 - DNA, 15 bp, Artificial Sequence
  dgRNA
  Iqgap3
ggacaggttagtgaa

SEQ ID NO: 65818 - DNA, 15 bp, Artificial Sequence
  dgRNA
  Iqgap3
aggttagtgaaagga

SEQ ID NO: 65819 - DNA, 15 bp, Artificial Sequence
  dgRNA
  Insig1
tgtgcatacgtcata

SEQ ID NO: 65820 - DNA, 15 bp, Artificial Sequence
  dgRNA
  Insig1
gtgcatacgtcatat

SEQ ID NO: 65821 - DNA, 15 bp, Artificial Sequence
  dgRNA
  Insig1
ccgccctcctcccat

SEQ ID NO: 65822 - DNA, 15 bp, Artificial Sequence
  dgRNA
  Insig1
tcccattggctccgg

SEQ ID NO: 65823 - DNA, 15 bp, Artificial Sequence
  dgRNA
  Fgfr2
ctgcgggcagcgcgg

SEQ ID NO: 65824 - DNA, 15 bp, Artificial Sequence
  dgRNA
  Fgfr2
tgcgggcagcgcggc

SEQ ID NO: 65825 - DNA, 15 bp, Artificial Sequence
  dgRNA
  Fgfr2
ccgcgctgcccgcag

SEQ ID NO: 65826 - DNA, 15 bp, Artificial Sequence
  dgRNA
  Fgfr2
gccgcgctgcccgca

SEQ ID NO: 65827 - DNA, 15 bp, Artificial Sequence
  dgRNA
  Ksr2
gggaccccgcctccc

SEQ ID NO: 65828 - DNA, 15 bp, Artificial Sequence
  dgRNA
  Ksr2
cgcctccccggctgg

SEQ ID NO: 65829 - DNA, 15 bp, Artificial Sequence
  dgRNA
  Ksr2
tccccggctggaggg

SEQ ID NO: 65830 - DNA, 15 bp, Artificial Sequence
  dgRNA
  Ksr2
tggagggtggcccgg

SEQ ID NO: 65831 - DNA, 15 bp, Artificial Sequence
  dgRNA
  Ankfy1
atgattcccttgcgc

SEQ ID NO: 65832 - DNA, 15 bp, Artificial Sequence
  dgRNA
  Ankfy1
ccggcatttatcgcg

SEQ ID NO: 65833 - DNA, 15 bp, Artificial Sequence
  dgRNA
  Ankfy1
tccaggcgatcgtca

SEQ ID NO: 65834 - DNA, 15 bp, Artificial Sequence
  dgRNA
  Ankfy1
ctccaggcgatcgtc

SEQ ID NO: 65835 - DNA, 15 bp, Artificial Sequence
  dgRNA
  Tcea1
ccgtccgctgtggcc

SEQ ID NO: 65836 - DNA, 15 bp, Artificial Sequence
  dgRNA
  Tcea1
gctgtggccgggcga

SEQ ID NO: 65837 - DNA, 15 bp, Artificial Sequence
  dgRNA
  Tcea1
ctgtggccgggcgag

SEQ ID NO: 65838 - DNA, 15 bp, Artificial Sequence
  dgRNA
  Tcea1
aaagaatgcggtaag

SEQ ID NO: 65839 - DNA, 15 bp, Artificial Sequence
  dgRNA
  Lyzl4
gtgcgatccatttga

SEQ ID NO: 65840 - DNA, 15 bp, Artificial Sequence
  dgRNA
  Lyzl4
aaggaagtcgctctc

SEQ ID NO: 65841 - DNA, 15 bp, Artificial Sequence
  dgRNA
  Lyzl4
aggaagtcgctctcc

SEQ ID NO: 65842 - DNA, 15 bp, Artificial Sequence
  dgRNA
  Lyzl4
tctccgggcgctttc

SEQ ID NO: 65843 - DNA, 15 bp, Artificial Sequence
  dgRNA
  Rabl2
aacagatgcgcatcc

SEQ ID NO: 65844 - DNA, 15 bp, Artificial Sequence
  dgRNA
  Rabl2
gcccgcgcctcgctg

SEQ ID NO: 65845 - DNA, 15 bp, Artificial Sequence
  dgRNA
  Rabl2
catatggccagcaac

SEQ ID NO: 65846 - DNA, 15 bp, Artificial Sequence
  dgRNA
  Rabl2
aaccgcaggttggag

SEQ ID NO: 65847 - DNA, 15 bp, Artificial Sequence
  dgRNA
  Acpp
gagttacgcctgctc

SEQ ID NO: 65848 - DNA, 15 bp, Artificial Sequence
  dgRNA
  Acpp
ggctcctaattgaag

SEQ ID NO: 65849 - DNA, 15 bp, Artificial Sequence
  dgRNA
  Acpp
ccttgcaatcctaat

SEQ ID NO: 65850 - DNA, 15 bp, Artificial Sequence
  dgRNA
  Acpp
cttgcaatcctaata

SEQ ID NO: 65851 - DNA, 15 bp, Artificial Sequence
  dgRNA
  Mrps21
gtacttactaagata

SEQ ID NO: 65852 - DNA, 15 bp, Artificial Sequence
  dgRNA
  Mrps21
cttacattgagtctc

SEQ ID NO: 65853 - DNA, 15 bp, Artificial Sequence
  dgRNA
  Mrps21
aagtacaagtaagtc

SEQ ID NO: 65854 - DNA, 15 bp, Artificial Sequence
  dgRNA
  Mrps21
gtcacaacttaccat

SEQ ID NO: 65855 - DNA, 15 bp, Artificial Sequence
  dgRNA
  Zfp341
tgtgtgcagcgatca

SEQ ID NO: 65856 - DNA, 15 bp, Artificial Sequence
  dgRNA
  Zfp341
gtgtgcagcgatcat

SEQ ID NO: 65857 - DNA, 15 bp, Artificial Sequence
  dgRNA
  Zfp341
tgtgcagcgatcatg

SEQ ID NO: 65858 - DNA, 15 bp, Artificial Sequence
  dgRNA
  Zfp341
tgcgtgttgaagaac

SEQ ID NO: 65859 - DNA, 15 bp, Artificial Sequence
  dgRNA
  Dhrs11
ggacgggctcgtgcg

SEQ ID NO: 65860 - DNA, 15 bp, Artificial Sequence
  dgRNA
  Dhrs11
gacgggctcgtgcgc

SEQ ID NO: 65861 - DNA, 15 bp, Artificial Sequence
  dgRNA
  Dhrs11
gctcgtgcgcgggcg

SEQ ID NO: 65862 - DNA, 15 bp, Artificial Sequence
  dgRNA
  Dhrs11
ctcgtgcgcgggcgt

SEQ ID NO: 65863 - DNA, 15 bp, Artificial Sequence
  dgRNA
  Snapc4
ggcggtcccaggttg

SEQ ID NO: 65864 - DNA, 15 bp, Artificial Sequence
  dgRNA
  Snapc4
gcggtcccaggttgt

SEQ ID NO: 65865 - DNA, 15 bp, Artificial Sequence
  dgRNA
  Snapc4
cgaggacgacacaca

SEQ ID NO: 65866 - DNA, 15 bp, Artificial Sequence
  dgRNA
  Snapc4
gatgaacgcctcgct

SEQ ID NO: 65867 - DNA, 15 bp, Artificial Sequence
  dgRNA
  Thrb
gagttgacaggtcaa

SEQ ID NO: 65868 - DNA, 15 bp, Artificial Sequence
  dgRNA
  Thrb
ggaatagggctcgct

SEQ ID NO: 65869 - DNA, 15 bp, Artificial Sequence
  dgRNA
  Thrb
gaatagggctcgctc

SEQ ID NO: 65870 - DNA, 15 bp, Artificial Sequence
  dgRNA
  Thrb
gagcccgcgcagtac

SEQ ID NO: 65871 - DNA, 15 bp, Artificial Sequence
  dgRNA
  Gnal
cccggcgccgttagc

SEQ ID NO: 65872 - DNA, 15 bp, Artificial Sequence
  dgRNA
  Gnal
ccggcgccgttagcc

SEQ ID NO: 65873 - DNA, 15 bp, Artificial Sequence
  dgRNA
  Gnal
ttagccgggagcgtg

SEQ ID NO: 65874 - DNA, 15 bp, Artificial Sequence
  dgRNA
  Gnal
gccgggagcgtgcgg

SEQ ID NO: 65875 - DNA, 15 bp, Artificial Sequence
  dgRNA
  Spire1
tgatgagatcatagt

SEQ ID NO: 65876 - DNA, 15 bp, Artificial Sequence
  dgRNA
  Spire1
agatcatagttggat

SEQ ID NO: 65877 - DNA, 15 bp, Artificial Sequence
  dgRNA
  Spire1
gatcatagttggatt

SEQ ID NO: 65878 - DNA, 15 bp, Artificial Sequence
  dgRNA
  Spire1
atagttggattgggc

SEQ ID NO: 65879 - DNA, 15 bp, Artificial Sequence
  dgRNA
  Srrm1
aaaaaaagatcggta

SEQ ID NO: 65880 - DNA, 15 bp, Artificial Sequence
  dgRNA
  Srrm1
aaagatcggtagggt

SEQ ID NO: 65881 - DNA, 15 bp, Artificial Sequence
  dgRNA
  Srrm1
aagatcggtagggtt

SEQ ID NO: 65882 - DNA, 15 bp, Artificial Sequence
  dgRNA
  Srrm1
tcccctcctagcgaa

SEQ ID NO: 65883 - DNA, 15 bp, Artificial Sequence
  dgRNA
  Tmem215
acctggttgctgtcg

SEQ ID NO: 65884 - DNA, 15 bp, Artificial Sequence
  dgRNA
  Tmem215
ggttgctgtcggggc

SEQ ID NO: 65885 - DNA, 15 bp, Artificial Sequence
  dgRNA
  Tmem215
gttgctgtcggggca

SEQ ID NO: 65886 - DNA, 15 bp, Artificial Sequence
  dgRNA
  Tmem215
ttgctgtcggggcag

SEQ ID NO: 65887 - DNA, 15 bp, Artificial Sequence
  dgRNA
  Olfr248
gtatcgtctacatac

SEQ ID NO: 65888 - DNA, 15 bp, Artificial Sequence
  dgRNA
  Olfr248
tatcgtctacataca

SEQ ID NO: 65889 - DNA, 15 bp, Artificial Sequence
  dgRNA
  Mthfd2l
ctgcaagaacggccg

SEQ ID NO: 65890 - DNA, 15 bp, Artificial Sequence
  dgRNA
  Mthfd2l
tggcgacagcgtgca

SEQ ID NO: 65891 - DNA, 15 bp, Artificial Sequence
  dgRNA
  Mthfd2l
ggcgacagcgtgcac

SEQ ID NO: 65892 - DNA, 15 bp, Artificial Sequence
  dgRNA
  Mthfd2l
tcgcccgccaccccg

SEQ ID NO: 65893 - DNA, 15 bp, Artificial Sequence
  dgRNA
  Gria3
ctcagaaatcgcttt

SEQ ID NO: 65894 - DNA, 15 bp, Artificial Sequence
  dgRNA
  Gria3
tcagaaatcgctttg

SEQ ID NO: 65895 - DNA, 15 bp, Artificial Sequence
  dgRNA
  Gria3
acccgccttccagat

SEQ ID NO: 65896 - DNA, 15 bp, Artificial Sequence
  dgRNA
  Gria3
tcattggctgcaagc

SEQ ID NO: 65897 - DNA, 15 bp, Artificial Sequence
  dgRNA
  Mtap7d3
tgctacctatattga

SEQ ID NO: 65898 - DNA, 15 bp, Artificial Sequence
  dgRNA
  Mtap7d3
atattgaaggttcat

SEQ ID NO: 65899 - DNA, 15 bp, Artificial Sequence
  dgRNA
  Mtap7d3
ttcatgggaagtgcg

SEQ ID NO: 65900 - DNA, 15 bp, Artificial Sequence
  dgRNA
  Mtap7d3
cctttcttatattgg

SEQ ID NO: 65901 - DNA, 15 bp, Artificial Sequence
  dgRNA
  Dab2
ccacgccactcgaag

SEQ ID NO: 65902 - DNA, 15 bp, Artificial Sequence
  dgRNA
  Dab2
tcgaagtggcaatcc

SEQ ID NO: 65903 - DNA, 15 bp, Artificial Sequence
  dgRNA
  Dab2
cgaagtggcaatcca

SEQ ID NO: 65904 - DNA, 15 bp, Artificial Sequence
  dgRNA
  Dab2
cgaaacgcagctcag

SEQ ID NO: 65905 - DNA, 15 bp, Artificial Sequence
  dgRNA
  Chic2
ctctgcttcgcatcg

SEQ ID NO: 65906 - DNA, 15 bp, Artificial Sequence
  dgRNA
  Chic2
aacgttttattaaac

SEQ ID NO: 65907 - DNA, 15 bp, Artificial Sequence
  dgRNA
  Chic2
ttctctggtccggcc

SEQ ID NO: 65908 - DNA, 15 bp, Artificial Sequence
  dgRNA
  Chic2
tctctggtccggcca

SEQ ID NO: 65909 - DNA, 15 bp, Artificial Sequence
  dgRNA
  Vsig8
aattacaagtcccgc

SEQ ID NO: 65910 - DNA, 15 bp, Artificial Sequence
  dgRNA
  Vsig8
cccctgcactactct

SEQ ID NO: 65911 - DNA, 15 bp, Artificial Sequence
  dgRNA
  Vsig8
ccctgcactactctt

SEQ ID NO: 65912 - DNA, 15 bp, Artificial Sequence
  dgRNA
  Vsig8
cactactcttgggac

SEQ ID NO: 65913 - DNA, 15 bp, Artificial Sequence
  dgRNA
  Olfr524
tttacctgagtctcg

SEQ ID NO: 65914 - DNA, 15 bp, Artificial Sequence
  dgRNA
  Olfr524
tgtgtcgtagtgaac

SEQ ID NO: 65915 - DNA, 15 bp, Artificial Sequence
  dgRNA
  Olfr524
acggatcagctagtc

SEQ ID NO: 65916 - DNA, 15 bp, Artificial Sequence
  dgRNA
  Olfr524
gagtccccgagactc

SEQ ID NO: 65917 - DNA, 15 bp, Artificial Sequence
  dgRNA
  Syne3
ccgtctgctccgggc

SEQ ID NO: 65918 - DNA, 15 bp, Artificial Sequence
  dgRNA
  Syne3
cgtctgctccgggca

SEQ ID NO: 65919 - DNA, 15 bp, Artificial Sequence
  dgRNA
  Syne3
cgggcagggtgagta

SEQ ID NO: 65920 - DNA, 15 bp, Artificial Sequence
  dgRNA
  Syne3
gtaaggtcagggcgg

SEQ ID NO: 65921 - DNA, 15 bp, Artificial Sequence
  dgRNA
  Itln1
atgctgtatctacat

SEQ ID NO: 65922 - DNA, 15 bp, Artificial Sequence
  dgRNA
  Itln1
aagtttgtgcctcac

SEQ ID NO: 65923 - DNA, 15 bp, Artificial Sequence
  dgRNA
  Itln1
ctaagaggtgatgtt

SEQ ID NO: 65924 - DNA, 15 bp, Artificial Sequence
  dgRNA
  Itln1
tctaagaggtgatgt

SEQ ID NO: 65925 - DNA, 15 bp, Artificial Sequence
  dgRNA
  Osbpl6
ggcgcggaggaccac

SEQ ID NO: 65926 - DNA, 15 bp, Artificial Sequence
  dgRNA
  Osbpl6
gcggaggaccactgg

SEQ ID NO: 65927 - DNA, 15 bp, Artificial Sequence
  dgRNA
  Osbpl6
actggaggcgccgcg

SEQ ID NO: 65928 - DNA, 15 bp, Artificial Sequence
  dgRNA
  Osbpl6
gcgcggcgcctccag

SEQ ID NO: 65929 - DNA, 15 bp, Artificial Sequence
  dgRNA
  Masp1
gaggggatctgttgc

SEQ ID NO: 65930 - DNA, 15 bp, Artificial Sequence
  dgRNA
  Masp1
ggatctgttgcaggc

SEQ ID NO: 65931 - DNA, 15 bp, Artificial Sequence
  dgRNA
  Masp1
aaggcgtgacctgaa

SEQ ID NO: 65932 - DNA, 15 bp, Artificial Sequence
  dgRNA
  Masp1
tcgctgacaccacac

SEQ ID NO: 65933 - DNA, 15 bp, Artificial Sequence
  dgRNA
  Acvr1c
gaaaagctaatctcg

SEQ ID NO: 65934 - DNA, 15 bp, Artificial Sequence
  dgRNA
  Acvr1c
ctaatctcggggacc

SEQ ID NO: 65935 - DNA, 15 bp, Artificial Sequence
  dgRNA
  Acvr1c
ctcggggacctggcg

SEQ ID NO: 65936 - DNA, 15 bp, Artificial Sequence
  dgRNA
  Acvr1c
ctcttcgcccacaag

SEQ ID NO: 65937 - DNA, 15 bp, Artificial Sequence
  dgRNA
  Ccr8
gtcccaaacagcaga

SEQ ID NO: 65938 - DNA, 15 bp, Artificial Sequence
  dgRNA
  Ccr8
tactgttccaacctt

SEQ ID NO: 65939 - DNA, 15 bp, Artificial Sequence
  dgRNA
  Ccr8
cgtgctatgcaacca

SEQ ID NO: 65940 - DNA, 15 bp, Artificial Sequence
  dgRNA
  Ccr8
gcgtgctatgcaacc

SEQ ID NO: 65941 - DNA, 15 bp, Artificial Sequence
  dgRNA
  Hnrnpk
ggtttttgacccgga

SEQ ID NO: 65942 - DNA, 15 bp, Artificial Sequence
  dgRNA
  Hnrnpk
tggtttttgacccgg

SEQ ID NO: 65943 - DNA, 15 bp, Artificial Sequence
  dgRNA
  Hnrnpk
tggtggtttttgacc

SEQ ID NO: 65944 - DNA, 15 bp, Artificial Sequence
  dgRNA
  Nps
cagacagcaaacgtg

SEQ ID NO: 65945 - DNA, 15 bp, Artificial Sequence
  dgRNA
  Nps
caaacgtgaggaaat

SEQ ID NO: 65946 - DNA, 15 bp, Artificial Sequence
  dgRNA
  Nps
aaaacccatctgcgc

SEQ ID NO: 65947 - DNA, 15 bp, Artificial Sequence
  dgRNA
  Nps
catctgcgcaggtct

SEQ ID NO: 65948 - DNA, 15 bp, Artificial Sequence
  dgRNA
  Elovl1
acctacaaacttatc

SEQ ID NO: 65949 - DNA, 15 bp, Artificial Sequence
  dgRNA
  Elovl1
acaaacttatctggc

SEQ ID NO: 65950 - DNA, 15 bp, Artificial Sequence
  dgRNA
  Elovl1
ccatgcccaacgtag

SEQ ID NO: 65951 - DNA, 15 bp, Artificial Sequence
  dgRNA
  Elovl1
catgcccaacgtagc

SEQ ID NO: 65952 - DNA, 15 bp, Artificial Sequence
  dgRNA
  Elp6
tcgtgctaaatcgtg

SEQ ID NO: 65953 - DNA, 15 bp, Artificial Sequence
  dgRNA
  Elp6
cgtgctaaatcgtga

SEQ ID NO: 65954 - DNA, 15 bp, Artificial Sequence
  dgRNA
  Elp6
tgagagatcgctcta

SEQ ID NO: 65955 - DNA, 15 bp, Artificial Sequence
  dgRNA
  Elp6
cgatttagcacgagc

SEQ ID NO: 65956 - DNA, 15 bp, Artificial Sequence
  dgRNA
  Csnk1e
cctttaaatcctccg

SEQ ID NO: 65957 - DNA, 15 bp, Artificial Sequence
  dgRNA
  Csnk1e
ttaaatcctccgggg

SEQ ID NO: 65958 - DNA, 15 bp, Artificial Sequence
  dgRNA
  Csnk1e
aatcctccggggcgg

SEQ ID NO: 65959 - DNA, 15 bp, Artificial Sequence
  dgRNA
  Csnk1e
gatgacatcagcggg

SEQ ID NO: 65960 - DNA, 15 bp, Artificial Sequence
  dgRNA
  Limch1
ttgtaatgaacgcga

SEQ ID NO: 65961 - DNA, 15 bp, Artificial Sequence
  dgRNA
  Limch1
tgaacgcgaaggcac

SEQ ID NO: 65962 - DNA, 15 bp, Artificial Sequence
  dgRNA
  Limch1
cgcgaaggcactggc

SEQ ID NO: 65963 - DNA, 15 bp, Artificial Sequence
  dgRNA
  Limch1
ttttattataatacg

SEQ ID NO: 65964 - DNA, 15 bp, Artificial Sequence
  dgRNA
  Ppp1r10
ggtgctccgtcgctt

SEQ ID NO: 65965 - DNA, 15 bp, Artificial Sequence
  dgRNA
  Ppp1r10
gctccgtcgctttgg

SEQ ID NO: 65966 - DNA, 15 bp, Artificial Sequence
  dgRNA
  Ppp1r10
ctccgtcgctttgga

SEQ ID NO: 65967 - DNA, 15 bp, Artificial Sequence
  dgRNA
  Ppp1r10
acgttttgccgagag

SEQ ID NO: 65968 - DNA, 15 bp, Artificial Sequence
  dgRNA
  Bbs2
ctattgacgtttgcc

SEQ ID NO: 65969 - DNA, 15 bp, Artificial Sequence
  dgRNA
  Bbs2
tattgacgtttgcct

SEQ ID NO: 65970 - DNA, 15 bp, Artificial Sequence
  dgRNA
  Bbs2
gcgtgtgcatgtcct

SEQ ID NO: 65971 - DNA, 15 bp, Artificial Sequence
  dgRNA
  Bbs2
ggcggatagttaagt

SEQ ID NO: 65972 - DNA, 15 bp, Artificial Sequence
  dgRNA
  Adss
agcagcgcgccaagc

SEQ ID NO: 65973 - DNA, 15 bp, Artificial Sequence
  dgRNA
  Adss
gcagcgcgccaagcc

SEQ ID NO: 65974 - DNA, 15 bp, Artificial Sequence
  dgRNA
  Adss
gcgccaagccgggga

SEQ ID NO: 65975 - DNA, 15 bp, Artificial Sequence
  dgRNA
  Adss
cgccaagccggggat

SEQ ID NO: 65976 - DNA, 15 bp, Artificial Sequence
  dgRNA
  Clec2d
cagatggcgccagtg

SEQ ID NO: 65977 - DNA, 15 bp, Artificial Sequence
  dgRNA
  Clec2d
cacactggcgccatc

SEQ ID NO: 65978 - DNA, 15 bp, Artificial Sequence
  dgRNA
  Clec2d
acgcatttcaaggtc

SEQ ID NO: 65979 - DNA, 15 bp, Artificial Sequence
  dgRNA
  Clec2d
gggaaacgcatttca

SEQ ID NO: 65980 - DNA, 15 bp, Artificial Sequence
  dgRNA
  Mfsd9
gaattaagacgcccg

SEQ ID NO: 65981 - DNA, 15 bp, Artificial Sequence
  dgRNA
  Mfsd9
taagacgcccgcggt

SEQ ID NO: 65982 - DNA, 15 bp, Artificial Sequence
  dgRNA
  Mfsd9
accttccatctgcgc

SEQ ID NO: 65983 - DNA, 15 bp, Artificial Sequence
  dgRNA
  Mfsd9
agatcgcttccgcca

SEQ ID NO: 65984 - DNA, 15 bp, Artificial Sequence
  dgRNA
  Gcdh
tttgcggatttcgca

SEQ ID NO: 65985 - DNA, 15 bp, Artificial Sequence
  dgRNA
  Gcdh
ggatttcgcaaggtc

SEQ ID NO: 65986 - DNA, 15 bp, Artificial Sequence
  dgRNA
  Gcdh
cgttcttattgaact

SEQ ID NO: 65987 - DNA, 15 bp, Artificial Sequence
  dgRNA
  Gcdh
gggatcccgcttctc

SEQ ID NO: 65988 - DNA, 15 bp, Artificial Sequence
  dgRNA
  AY074887
cccgaattgactctc

SEQ ID NO: 65989 - DNA, 15 bp, Artificial Sequence
  dgRNA
  AY074887
ccgaattgactctct

SEQ ID NO: 65990 - DNA, 15 bp, Artificial Sequence
  dgRNA
  AY074887
cccctcgcaccggcc

SEQ ID NO: 65991 - DNA, 15 bp, Artificial Sequence
  dgRNA
  AY074887
ctcgcaccggcccgg

SEQ ID NO: 65992 - DNA, 15 bp, Artificial Sequence
  dgRNA
  Dcaf17
taacgctgcacctcg

SEQ ID NO: 65993 - DNA, 15 bp, Artificial Sequence
  dgRNA
  Dcaf17
tcaacggcgccttcc

SEQ ID NO: 65994 - DNA, 15 bp, Artificial Sequence
  dgRNA
  Dcaf17
acggatttgacgcaa

SEQ ID NO: 65995 - DNA, 15 bp, Artificial Sequence
  dgRNA
  Rpl14
cactgcacgtgtctg

SEQ ID NO: 65996 - DNA, 15 bp, Artificial Sequence
  dgRNA
  Rpl14
tccccgtcgaccaat

SEQ ID NO: 65997 - DNA, 15 bp, Artificial Sequence
  dgRNA
  Rpl14
cgtcgaccaatcggt

SEQ ID NO: 65998 - DNA, 15 bp, Artificial Sequence
  dgRNA
  Rpl14
aatcggtgggcacgc

SEQ ID NO: 65999 - DNA, 15 bp, Artificial Sequence
  dgRNA
  Large
gcgtagagcagctct

SEQ ID NO: 66000 - DNA, 15 bp, Artificial Sequence
  dgRNA
  Large
tctcggcagccgcct

SEQ ID NO: 66001 - DNA, 15 bp, Artificial Sequence
  dgRNA
  Large
cggcagccgcctcgg

SEQ ID NO: 66002 - DNA, 15 bp, Artificial Sequence
  dgRNA
  Large
cagccgcctcggagg

SEQ ID NO: 66003 - DNA, 15 bp, Artificial Sequence
  dgRNA
  Cyp2c54
caatcaattgcactt

SEQ ID NO: 66004 - DNA, 15 bp, Artificial Sequence
  dgRNA
  Nfasc
ccctaatgcggcggc

SEQ ID NO: 66005 - DNA, 15 bp, Artificial Sequence
  dgRNA
  Tomm40
aaacagcggtggcgg

SEQ ID NO: 66006 - DNA, 15 bp, Artificial Sequence
  dgRNA
  Il2rb
gctgcccctgggcgt

SEQ ID NO: 66007 - DNA, 15 bp, Artificial Sequence
  dgRNA
  Il2rb
gcccctgggcgtagg

SEQ ID NO: 66008 - DNA, 15 bp, Artificial Sequence
  dgRNA
  Il2rb
gatcttatcagtgct

SEQ ID NO: 66009 - DNA, 15 bp, Artificial Sequence
  dgRNA
  Il2rb
cctcatcctctatac

SEQ ID NO: 66010 - DNA, 15 bp, Artificial Sequence
  dgRNA
  Syt6
gggatgccacgtgag

SEQ ID NO: 66011 - DNA, 15 bp, Artificial Sequence
  dgRNA
  Syt6
gccacgtgaggggcg

SEQ ID NO: 66012 - DNA, 15 bp, Artificial Sequence
  dgRNA
  Syt6
ggcggggaccctgcg

SEQ ID NO: 66013 - DNA, 15 bp, Artificial Sequence
  dgRNA
  Syt6
gagcggagcctcagg

SEQ ID NO: 66014 - DNA, 15 bp, Artificial Sequence
  dgRNA
  Myadm
accctcccttttgca

SEQ ID NO: 66015 - DNA, 15 bp, Artificial Sequence
  dgRNA
  Myadm
aagaagcaagcgtcc

SEQ ID NO: 66016 - DNA, 15 bp, Artificial Sequence
  dgRNA
  Myadm
tgccttgcaaaaggg

SEQ ID NO: 66017 - DNA, 15 bp, Artificial Sequence
  dgRNA
  Myadm
cgtgctttgcagaag

SEQ ID NO: 66018 - DNA, 15 bp, Artificial Sequence
  dgRNA
  Pros1
ctgataagcttccct

SEQ ID NO: 66019 - DNA, 15 bp, Artificial Sequence
  dgRNA
  Pros1
ccgacctccttcccg

SEQ ID NO: 66020 - DNA, 15 bp, Artificial Sequence
  dgRNA
  Pros1
cttcccctcccgggc

SEQ ID NO: 66021 - DNA, 15 bp, Artificial Sequence
  dgRNA
  Pros1
ttcccctcccgggct

SEQ ID NO: 66022 - DNA, 15 bp, Artificial Sequence
  dgRNA
  Plce1
gtaggaaattacaac

SEQ ID NO: 66023 - DNA, 15 bp, Artificial Sequence
  dgRNA
  Plce1
gcttcgcacaaagac

SEQ ID NO: 66024 - DNA, 15 bp, Artificial Sequence
  dgRNA
  BC051142
acgtgcacccacttc

SEQ ID NO: 66025 - DNA, 15 bp, Artificial Sequence
  dgRNA
  BC051142
ctcatatcctagagc

SEQ ID NO: 66026 - DNA, 15 bp, Artificial Sequence
  dgRNA
  BC051142
gctgtggacgcctcc

SEQ ID NO: 66027 - DNA, 15 bp, Artificial Sequence
  dgRNA
  BC051142
gctcagcctcttgat

SEQ ID NO: 66028 - DNA, 15 bp, Artificial Sequence
  dgRNA
  Cd244
ctgggattttgcaac

SEQ ID NO: 66029 - DNA, 15 bp, Artificial Sequence
  dgRNA
  Cd244
tgagtacccacccac

SEQ ID NO: 66030 - DNA, 15 bp, Artificial Sequence
  dgRNA
  Cd244
gtacccacccactgg

SEQ ID NO: 66031 - DNA, 15 bp, Artificial Sequence
  dgRNA
  Cd244
aggcatcttagcttg

SEQ ID NO: 66032 - DNA, 15 bp, Artificial Sequence
  dgRNA
  Zfp280c
aggccagcctatatt

SEQ ID NO: 66033 - DNA, 15 bp, Artificial Sequence
  dgRNA
  Zfp280c
aaggccagcctatat

SEQ ID NO: 66034 - DNA, 15 bp, Artificial Sequence
  dgRNA
  Zfp280c
aagtggcgaaacgct

SEQ ID NO: 66035 - DNA, 15 bp, Artificial Sequence
  dgRNA
  Zfp280c
taagtggcgaaacgc

SEQ ID NO: 66036 - DNA, 15 bp, Artificial Sequence
  dgRNA
  Cacng3
acatatgaatggttc

SEQ ID NO: 66037 - DNA, 15 bp, Artificial Sequence
  dgRNA
  Cacng3
catatgaatggttct

SEQ ID NO: 66038 - DNA, 15 bp, Artificial Sequence
  dgRNA
  Cacng3
agctcagatttacac

SEQ ID NO: 66039 - DNA, 15 bp, Artificial Sequence
  dgRNA
  Ern2
catttggtgccaagg

SEQ ID NO: 66040 - DNA, 15 bp, Artificial Sequence
  dgRNA
  Ern2
ggactgggtgaaacg

SEQ ID NO: 66041 - DNA, 15 bp, Artificial Sequence
  dgRNA
  Ern2
gactgggtgaaacgt

SEQ ID NO: 66042 - DNA, 15 bp, Artificial Sequence
  dgRNA
  Ern2
gaaacgtgggtgcga

SEQ ID NO: 66043 - DNA, 15 bp, Artificial Sequence
  dgRNA
  Cer1
cagctaattaccccc

SEQ ID NO: 66044 - DNA, 15 bp, Artificial Sequence
  dgRNA
  Cer1
agctaattaccccct

SEQ ID NO: 66045 - DNA, 15 bp, Artificial Sequence
  dgRNA
  Cer1
ttaccccctgggtct

SEQ ID NO: 66046 - DNA, 15 bp, Artificial Sequence
  dgRNA
  Cer1
gtctcgggctttcac

SEQ ID NO: 66047 - DNA, 15 bp, Artificial Sequence
  dgRNA
  Slc25a2
tacacgcccaactcc

SEQ ID NO: 66048 - DNA, 15 bp, Artificial Sequence
  dgRNA
  Slc25a2
aaagcgtttcctcct

SEQ ID NO: 66049 - DNA, 15 bp, Artificial Sequence
  dgRNA
  Slc25a2
cctcctaggtattta

SEQ ID NO: 66050 - DNA, 15 bp, Artificial Sequence
  dgRNA
  Slc25a2
ctcctaggtatttat

SEQ ID NO: 66051 - DNA, 15 bp, Artificial Sequence
  dgRNA
  Bmp2k
aacagccgcaagggg

SEQ ID NO: 66052 - DNA, 15 bp, Artificial Sequence
  dgRNA
  Bmp2k
acagccgcaaggggc

SEQ ID NO: 66053 - DNA, 15 bp, Artificial Sequence
  dgRNA
  Bmp2k
gccgcaaggggcggg

SEQ ID NO: 66054 - DNA, 15 bp, Artificial Sequence
  dgRNA
  Bmp2k
aggggcgggcggcat

SEQ ID NO: 66055 - DNA, 15 bp, Artificial Sequence
  dgRNA
  Olfr679
gctctgaatatatga

SEQ ID NO: 66056 - DNA, 15 bp, Artificial Sequence
  dgRNA
  Olfr679
tagataattaggttc

SEQ ID NO: 66057 - DNA, 15 bp, Artificial Sequence
  dgRNA
  Gcnt3
ctcgagctagactac

SEQ ID NO: 66058 - DNA, 15 bp, Artificial Sequence
  dgRNA
  Gcnt3
aatcacatagacccg

SEQ ID NO: 66059 - DNA, 15 bp, Artificial Sequence
  dgRNA
  Gcnt3
tagctcgagcgcata

SEQ ID NO: 66060 - DNA, 15 bp, Artificial Sequence
  dgRNA
  Gcnt3
tgtgattggcgtcat

SEQ ID NO: 66061 - DNA, 15 bp, Artificial Sequence
  dgRNA
  Mrgprx1
cggagataccagata

SEQ ID NO: 66062 - DNA, 15 bp, Artificial Sequence
  dgRNA
  Mrgprx1
gataccagataagga

SEQ ID NO: 66063 - DNA, 15 bp, Artificial Sequence
  dgRNA
  Mrgprx1
ataccagataaggag

SEQ ID NO: 66064 - DNA, 15 bp, Artificial Sequence
  dgRNA
  Mrgprx1
gcccaagaaatcgca

SEQ ID NO: 66065 - DNA, 15 bp, Artificial Sequence
  dgRNA
  Nradd
ggttctcagctctcg

SEQ ID NO: 66066 - DNA, 15 bp, Artificial Sequence
  dgRNA
  Nradd
tcgcggtccattgca

SEQ ID NO: 66067 - DNA, 15 bp, Artificial Sequence
  dgRNA
  Nradd
ctgcgtgctccggcg

SEQ ID NO: 66068 - DNA, 15 bp, Artificial Sequence
  dgRNA
  Nradd
tgcgtgctccggcgt

SEQ ID NO: 66069 - DNA, 15 bp, Artificial Sequence
  dgRNA
  Med12l
ccccggcgccgccga

SEQ ID NO: 66070 - DNA, 15 bp, Artificial Sequence
  dgRNA
  Med12l
cccggcgccgccgag

SEQ ID NO: 66071 - DNA, 15 bp, Artificial Sequence
  dgRNA
  Med12l
gcgcagctcgtgcac

SEQ ID NO: 66072 - DNA, 15 bp, Artificial Sequence
  dgRNA
  Med12l
actggctgaacccgg

SEQ ID NO: 66073 - DNA, 15 bp, Artificial Sequence
  dgRNA
  Acbd7
tgagctccgagacac

SEQ ID NO: 66074 - DNA, 15 bp, Artificial Sequence
  dgRNA
  Acbd7
gagctccgagacact

SEQ ID NO: 66075 - DNA, 15 bp, Artificial Sequence
  dgRNA
  Acbd7
accaataggagagac

SEQ ID NO: 66076 - DNA, 15 bp, Artificial Sequence
  dgRNA
  Acbd7
aataggagagaccgg

SEQ ID NO: 66077 - DNA, 15 bp, Artificial Sequence
  dgRNA
  Edf1
ccctgcgcagccaca

SEQ ID NO: 66078 - DNA, 15 bp, Artificial Sequence
  dgRNA
  Edf1
acgggactggaaccg

SEQ ID NO: 66079 - DNA, 15 bp, Artificial Sequence
  dgRNA
  Edf1
accgtggcggcgatc

SEQ ID NO: 66080 - DNA, 15 bp, Artificial Sequence
  dgRNA
  Edf1
tccacgcgccgcccg

SEQ ID NO: 66081 - DNA, 15 bp, Artificial Sequence
  dgRNA
  Tnrc6b
gagacggcagcggcg

SEQ ID NO: 66082 - DNA, 15 bp, Artificial Sequence
  dgRNA
  Tnrc6b
agcggcgaggactta

SEQ ID NO: 66083 - DNA, 15 bp, Artificial Sequence
  dgRNA
  Tnrc6b
gcggcgaggacttaa

SEQ ID NO: 66084 - DNA, 15 bp, Artificial Sequence
  dgRNA
  Tnrc6b
gcgaggacttaaggg

SEQ ID NO: 66085 - DNA, 15 bp, Artificial Sequence
  dgRNA
  Nvl
gttgaacgccttcaa

SEQ ID NO: 66086 - DNA, 15 bp, Artificial Sequence
  dgRNA
  Nvl
ttgaacgccttcaaa

SEQ ID NO: 66087 - DNA, 15 bp, Artificial Sequence
  dgRNA
  Nvl
tgaacgccttcaaag

SEQ ID NO: 66088 - DNA, 15 bp, Artificial Sequence
  dgRNA
  Nvl
gaacgccttcaaagg

SEQ ID NO: 66089 - DNA, 15 bp, Artificial Sequence
  dgRNA
  Grtp1
caaatccctagtgcc

SEQ ID NO: 66090 - DNA, 15 bp, Artificial Sequence
  dgRNA
  Grtp1
caggtgcactcggtt

SEQ ID NO: 66091 - DNA, 15 bp, Artificial Sequence
  dgRNA
  Grtp1
aggtgcactcggttc

SEQ ID NO: 66092 - DNA, 15 bp, Artificial Sequence
  dgRNA
  Grtp1
tcggttcgggtccct

SEQ ID NO: 66093 - DNA, 15 bp, Artificial Sequence
  dgRNA
  Actl6a
ctcggtccaccctac

SEQ ID NO: 66094 - DNA, 15 bp, Artificial Sequence
  dgRNA
  Actl6a
agttaattaggtact

SEQ ID NO: 66095 - DNA, 15 bp, Artificial Sequence
  dgRNA
  Actl6a
gagttaattaggtac

SEQ ID NO: 66096 - DNA, 15 bp, Artificial Sequence
  dgRNA
  Actl6a
cgcgaatagagtagg

SEQ ID NO: 66097 - DNA, 15 bp, Artificial Sequence
  dgRNA
  Vmn2r3
agctgcaatcaggtt

SEQ ID NO: 66098 - DNA, 15 bp, Artificial Sequence
  dgRNA
  Vmn2r3
tctaacactctatta

SEQ ID NO: 66099 - DNA, 15 bp, Artificial Sequence
  dgRNA
  Vmn2r3
attgagagtaattac

SEQ ID NO: 66100 - DNA, 15 bp, Artificial Sequence
  dgRNA
  Ptma
tgaatgacagtgcgg

SEQ ID NO: 66101 - DNA, 15 bp, Artificial Sequence
  dgRNA
  Ptma
gaatgacagtgcggc

SEQ ID NO: 66102 - DNA, 15 bp, Artificial Sequence
  dgRNA
  Ptma
aatgacagtgcggcg

SEQ ID NO: 66103 - DNA, 15 bp, Artificial Sequence
  dgRNA
  Ptma
atgacagtgcggcgg

SEQ ID NO: 66104 - DNA, 15 bp, Artificial Sequence
  dgRNA
  Thbs2
ccccgggcccctgtc

SEQ ID NO: 66105 - DNA, 15 bp, Artificial Sequence
  dgRNA
  Thbs2
ccagcaagattggct

SEQ ID NO: 66106 - DNA, 15 bp, Artificial Sequence
  dgRNA
  Thbs2
accagcaagattggc

SEQ ID NO: 66107 - DNA, 15 bp, Artificial Sequence
  dgRNA
  Thbs2
ccagacaggggcccg

SEQ ID NO: 66108 - DNA, 15 bp, Artificial Sequence
  dgRNA
  Gm2016
gtcattgtagagacg

SEQ ID NO: 66109 - DNA, 15 bp, Artificial Sequence
  dgRNA
  Gm2016
agagacggggcttta

SEQ ID NO: 66110 - DNA, 15 bp, Artificial Sequence
  dgRNA
  Exosc3
ctcaagtaggtgaaa

SEQ ID NO: 66111 - DNA, 15 bp, Artificial Sequence
  dgRNA
  Exosc3
ggagattgttacatt

SEQ ID NO: 66112 - DNA, 15 bp, Artificial Sequence
  dgRNA
  Exosc3
agggagtagcaccca

SEQ ID NO: 66113 - DNA, 15 bp, Artificial Sequence
  dgRNA
  Exosc3
gggagtagcacccat

SEQ ID NO: 66114 - DNA, 15 bp, Artificial Sequence
  dgRNA
  Vps29
ggctacgggcagagc

SEQ ID NO: 66115 - DNA, 15 bp, Artificial Sequence
  dgRNA
  Vps29
caagcgcgccagccg

SEQ ID NO: 66116 - DNA, 15 bp, Artificial Sequence
  dgRNA
  Vps29
ccagccgcgggtgcc

SEQ ID NO: 66117 - DNA, 15 bp, Artificial Sequence
  dgRNA
  Vps29
gatttcttgcagcgc

SEQ ID NO: 66118 - DNA, 15 bp, Artificial Sequence
  dgRNA
  Elk1
gacccaatcggcgtg

SEQ ID NO: 66119 - DNA, 15 bp, Artificial Sequence
  dgRNA
  Elk1
ctctatagattcagt

SEQ ID NO: 66120 - DNA, 15 bp, Artificial Sequence
  dgRNA
  Elk1
ccgattgggtcaagg

SEQ ID NO: 66121 - DNA, 15 bp, Artificial Sequence
  dgRNA
  Elk1
acgccgattgggtca

SEQ ID NO: 66122 - DNA, 15 bp, Artificial Sequence
  dgRNA
  2610044O15Rik8
cccgggatctgtaaa

SEQ ID NO: 66123 - DNA, 15 bp, Artificial Sequence
  dgRNA
  2610044O15Rik8
ggtctggcccgggac

SEQ ID NO: 66124 - DNA, 15 bp, Artificial Sequence
  dgRNA
  2610044O15Rik8
atcaaggctcccctg

SEQ ID NO: 66125 - DNA, 15 bp, Artificial Sequence
  dgRNA
  2610044O15Rik8
tacagatcccgggag

SEQ ID NO: 66126 - DNA, 15 bp, Artificial Sequence
  dgRNA
  Zmynd11
cgggtcagtagtaca

SEQ ID NO: 66127 - DNA, 15 bp, Artificial Sequence
  dgRNA
  Zmynd11
gggtcagtagtacac

SEQ ID NO: 66128 - DNA, 15 bp, Artificial Sequence
  dgRNA
  Zmynd11
caacacggagccatt

SEQ ID NO: 66129 - DNA, 15 bp, Artificial Sequence
  dgRNA
  Zmynd11
aagcaaagtgccgag

SEQ ID NO: 66130 - DNA, 15 bp, Artificial Sequence
  dgRNA
  Tmprss15
tactagttctcaacg

SEQ ID NO: 66131 - DNA, 15 bp, Artificial Sequence
  dgRNA
  Tmprss15
tctcaacgaggctaa

SEQ ID NO: 66132 - DNA, 15 bp, Artificial Sequence
  dgRNA
  Tmprss15
gtaatttacagttgt

SEQ ID NO: 66133 - DNA, 15 bp, Artificial Sequence
  dgRNA
  Tmprss15
gtccatttgtcaggg

SEQ ID NO: 66134 - DNA, 15 bp, Artificial Sequence
  dgRNA
  Coro2a
acaggtggtgtggcg

SEQ ID NO: 66135 - DNA, 15 bp, Artificial Sequence
  dgRNA
  Coro2a
gcacccggctgaaag

SEQ ID NO: 66136 - DNA, 15 bp, Artificial Sequence
  dgRNA
  Coro2a
cacccggctgaaaga

SEQ ID NO: 66137 - DNA, 15 bp, Artificial Sequence
  dgRNA
  Coro2a
cgcagcgccccctaa

SEQ ID NO: 66138 - DNA, 15 bp, Artificial Sequence
  dgRNA
  Slc45a4
gacctgtcctcctag

SEQ ID NO: 66139 - DNA, 15 bp, Artificial Sequence
  dgRNA
  Slc45a4
cagtggtgtcatagt

SEQ ID NO: 66140 - DNA, 15 bp, Artificial Sequence
  dgRNA
  Slc45a4
cttcccaatttctgc

SEQ ID NO: 66141 - DNA, 15 bp, Artificial Sequence
  dgRNA
  Slc45a4
tcacaaaggcataag

SEQ ID NO: 66142 - DNA, 15 bp, Artificial Sequence
  dgRNA
  Tsen34
gatggtggtacgctt

SEQ ID NO: 66143 - DNA, 15 bp, Artificial Sequence
  dgRNA
  Tsen34
ggggagcggaacggt

SEQ ID NO: 66144 - DNA, 15 bp, Artificial Sequence
  dgRNA
  Tsen34
cggaacggtgggacc

SEQ ID NO: 66145 - DNA, 15 bp, Artificial Sequence
  dgRNA
  Tsen34
ggaacggtgggacct

SEQ ID NO: 66146 - DNA, 15 bp, Artificial Sequence
  dgRNA
  Cplx3
tgctggcgctaaaga

SEQ ID NO: 66147 - DNA, 15 bp, Artificial Sequence
  dgRNA
  Cplx3
gctaaagaaggcacg

SEQ ID NO: 66148 - DNA, 15 bp, Artificial Sequence
  dgRNA
  Cplx3
ctaaagaaggcacgt

SEQ ID NO: 66149 - DNA, 15 bp, Artificial Sequence
  dgRNA
  Cplx3
gcaggcacgtggttc

SEQ ID NO: 66150 - DNA, 15 bp, Artificial Sequence
  dgRNA
  Adat2
cgacaaatcccagtt

SEQ ID NO: 66151 - DNA, 15 bp, Artificial Sequence
  dgRNA
  Adat2
cagtttggtatcagt

SEQ ID NO: 66152 - DNA, 15 bp, Artificial Sequence
  dgRNA
  Adat2
ccgaggactgtgccc

SEQ ID NO: 66153 - DNA, 15 bp, Artificial Sequence
  dgRNA
  Adat2
atttgtcgaagggat

SEQ ID NO: 66154 - DNA, 15 bp, Artificial Sequence
  dgRNA
  Igf1r
gactccgccgccccg

SEQ ID NO: 66155 - DNA, 15 bp, Artificial Sequence
  dgRNA
  Igf1r
actccgccgccccgt

SEQ ID NO: 66156 - DNA, 15 bp, Artificial Sequence
  dgRNA
  Igf1r
gtgggccgctgctgc

SEQ ID NO: 66157 - DNA, 15 bp, Artificial Sequence
  dgRNA
  Igf1r
tgctgccggcgctga

SEQ ID NO: 66158 - DNA, 15 bp, Artificial Sequence
  dgRNA
  Ybx1
agcgcagccccatct

SEQ ID NO: 66159 - DNA, 15 bp, Artificial Sequence
  dgRNA
  Ybx1
ctctgcgcgtcctcc

SEQ ID NO: 66160 - DNA, 15 bp, Artificial Sequence
  dgRNA
  Ybx1
cctcccggtactcta

SEQ ID NO: 66161 - DNA, 15 bp, Artificial Sequence
  dgRNA
  Ybx1
tggtgctcacggccg

SEQ ID NO: 66162 - DNA, 15 bp, Artificial Sequence
  dgRNA
  Rbpms
aaagcgcgctgcgtg

SEQ ID NO: 66163 - DNA, 15 bp, Artificial Sequence
  dgRNA
  Tbc1d14
aggtaacactccaac

SEQ ID NO: 66164 - DNA, 15 bp, Artificial Sequence
  dgRNA
  Tbc1d14
caacagaacagcgtt

SEQ ID NO: 66165 - DNA, 15 bp, Artificial Sequence
  dgRNA
  Tbc1d14
ttgctagtgcactag

SEQ ID NO: 66166 - DNA, 15 bp, Artificial Sequence
  dgRNA
  Tbc1d14
tttggatttctcggt

SEQ ID NO: 66167 - DNA, 15 bp, Artificial Sequence
  dgRNA
  Tmem43
gaacgtgtcagacgt

SEQ ID NO: 66168 - DNA, 15 bp, Artificial Sequence
  dgRNA
  Tmem43
aggacgcgcggaggc

SEQ ID NO: 66169 - DNA, 15 bp, Artificial Sequence
  dgRNA
  Tmem43
gcttaggacgcgcgg

SEQ ID NO: 66170 - DNA, 15 bp, Artificial Sequence
  dgRNA
  Tmem43
ggtgcttaggacgcg

SEQ ID NO: 66171 - DNA, 15 bp, Artificial Sequence
  dgRNA
  Lmln
aatccccgctagccc

SEQ ID NO: 66172 - DNA, 15 bp, Artificial Sequence
  dgRNA
  Lmln
atccccgctagccca

SEQ ID NO: 66173 - DNA, 15 bp, Artificial Sequence
  dgRNA
  Lmln
acagctcagttcacg

SEQ ID NO: 66174 - DNA, 15 bp, Artificial Sequence
  dgRNA
  Lmln
cagctcagttcacgt

SEQ ID NO: 66175 - DNA, 15 bp, Artificial Sequence
  dgRNA
  Gstm1
gtctggccagactcc

SEQ ID NO: 66176 - DNA, 15 bp, Artificial Sequence
  dgRNA
  Gstm1
tagggagcatccagc

SEQ ID NO: 66177 - DNA, 15 bp, Artificial Sequence
  dgRNA
  Gstm1
tccagcaggcggcga

SEQ ID NO: 66178 - DNA, 15 bp, Artificial Sequence
  dgRNA
  Gstm1
agcaggcggcgatgg

SEQ ID NO: 66179 - DNA, 15 bp, Artificial Sequence
  dgRNA
  Gabpb2
tttttccagctcacg

SEQ ID NO: 66180 - DNA, 15 bp, Artificial Sequence
  dgRNA
  Gabpb2
cacgaggtcctcagt

SEQ ID NO: 66181 - DNA, 15 bp, Artificial Sequence
  dgRNA
  Gabpb2
aggagtcggactcag

SEQ ID NO: 66182 - DNA, 15 bp, Artificial Sequence
  dgRNA
  Gabpb2
ctcagaggtgcgttg

SEQ ID NO: 66183 - DNA, 15 bp, Artificial Sequence
  dgRNA
  Olfr491
gactcgtgtctgtgg

SEQ ID NO: 66184 - DNA, 15 bp, Artificial Sequence
  dgRNA
  Olfr491
tacgactcgtgtctg

SEQ ID NO: 66185 - DNA, 15 bp, Artificial Sequence
  dgRNA
  Slc10a1
ttttgttgcaggtcc

SEQ ID NO: 66186 - DNA, 15 bp, Artificial Sequence
  dgRNA
  Slc10a1
gttgcaggtcctgga

SEQ ID NO: 66187 - DNA, 15 bp, Artificial Sequence
  dgRNA
  Slc10a1
ggtacgagctccact

SEQ ID NO: 66188 - DNA, 15 bp, Artificial Sequence
  dgRNA
  Slc10a1
cgagctccactcggc

SEQ ID NO: 66189 - DNA, 15 bp, Artificial Sequence
  dgRNA
  Prodh
cggagctaaaaagcc

SEQ ID NO: 66190 - DNA, 15 bp, Artificial Sequence
  dgRNA
  Prodh
aaagcccggttccca

SEQ ID NO: 66191 - DNA, 15 bp, Artificial Sequence
  dgRNA
  Prodh
aagcccggttcccaa

SEQ ID NO: 66192 - DNA, 15 bp, Artificial Sequence
  dgRNA
  Prodh
ccggttcccaaggga

SEQ ID NO: 66193 - DNA, 15 bp, Artificial Sequence
  dgRNA
  Olfr786
ctctatagcttcaat

SEQ ID NO: 66194 - DNA, 15 bp, Artificial Sequence
  dgRNA
  Olfr786
tagagtagtaaatct

SEQ ID NO: 66195 - DNA, 15 bp, Artificial Sequence
  dgRNA
  Plcd1
ggatctgactatttc

SEQ ID NO: 66196 - DNA, 15 bp, Artificial Sequence
  dgRNA
  Plcd1
gactatttctggccc

SEQ ID NO: 66197 - DNA, 15 bp, Artificial Sequence
  dgRNA
  Plcd1
cctggcgcacccagc

SEQ ID NO: 66198 - DNA, 15 bp, Artificial Sequence
  dgRNA
  Plcd1
gcccgagccccggcc

SEQ ID NO: 66199 - DNA, 15 bp, Artificial Sequence
  dgRNA
  Tmem64
atccgcagcaccagc

SEQ ID NO: 66200 - DNA, 15 bp, Artificial Sequence
  dgRNA
  Tmem64
tccgcagcaccagcc

SEQ ID NO: 66201 - DNA, 15 bp, Artificial Sequence
  dgRNA
  Tmem64
accagccgggcgtca

SEQ ID NO: 66202 - DNA, 15 bp, Artificial Sequence
  dgRNA
  Tmem64
ccagccgggcgtcac

SEQ ID NO: 66203 - DNA, 15 bp, Artificial Sequence
  dgRNA
  Olfr128
gattcttgccattga

SEQ ID NO: 66204 - DNA, 15 bp, Artificial Sequence
  dgRNA
  B3glct
gttctgggaagcgaa

SEQ ID NO: 66205 - DNA, 15 bp, Artificial Sequence
  dgRNA
  B3glct
aagcgaagggcatga

SEQ ID NO: 66206 - DNA, 15 bp, Artificial Sequence
  dgRNA
  B3glct
agggcgcggtccagc

SEQ ID NO: 66207 - DNA, 15 bp, Artificial Sequence
  dgRNA
  B3glct
gggcgcggtccagct

SEQ ID NO: 66208 - DNA, 15 bp, Artificial Sequence
  dgRNA
  Hus1b
agcatctgccctcgg

SEQ ID NO: 66209 - DNA, 15 bp, Artificial Sequence
  dgRNA
  Hus1b
ggcctcaggtgtaag

SEQ ID NO: 66210 - DNA, 15 bp, Artificial Sequence
  dgRNA
  Hus1b
gcctcaggtgtaagt

SEQ ID NO: 66211 - DNA, 15 bp, Artificial Sequence
  dgRNA
  Hus1b
tgtaagtgggcctgc

SEQ ID NO: 66212 - DNA, 15 bp, Artificial Sequence
  dgRNA
  Bcap29
gtcccaccatagacc

SEQ ID NO: 66213 - DNA, 15 bp, Artificial Sequence
  dgRNA
  Bcap29
catagacccgggccc

SEQ ID NO: 66214 - DNA, 15 bp, Artificial Sequence
  dgRNA
  Bcap29
ctggctcccgtcatc

SEQ ID NO: 66215 - DNA, 15 bp, Artificial Sequence
  dgRNA
  Bcap29
cggcatcagccgcat

SEQ ID NO: 66216 - DNA, 15 bp, Artificial Sequence
  dgRNA
  Cyp4a29
taaagggtatgatta

SEQ ID NO: 66217 - DNA, 15 bp, Artificial Sequence
  dgRNA
  Cyp4a29
tcataaactctagac

SEQ ID NO: 66218 - DNA, 15 bp, Artificial Sequence
  dgRNA
  Cyp4a29
atgagtcaatggtaa

SEQ ID NO: 66219 - DNA, 15 bp, Artificial Sequence
  dgRNA
  Pja2
gacgtggcagaaaaa

SEQ ID NO: 66220 - DNA, 15 bp, Artificial Sequence
  dgRNA
  Pja2
cgtcatggttggacg

SEQ ID NO: 66221 - DNA, 15 bp, Artificial Sequence
  dgRNA
  Rbbp5
tacgtaaaacgaaca

SEQ ID NO: 66222 - DNA, 15 bp, Artificial Sequence
  dgRNA
  Rbbp5
acgaacaaggaaggc

SEQ ID NO: 66223 - DNA, 15 bp, Artificial Sequence
  dgRNA
  Rbbp5
cgaacaaggaaggcg

SEQ ID NO: 66224 - DNA, 15 bp, Artificial Sequence
  dgRNA
  Rbbp5
ctataatattatcga

SEQ ID NO: 66225 - DNA, 15 bp, Artificial Sequence
  dgRNA
  Tcf20
agttaagggcgaagg

SEQ ID NO: 66226 - DNA, 15 bp, Artificial Sequence
  dgRNA
  Tcf20
gttaagggcgaagga

SEQ ID NO: 66227 - DNA, 15 bp, Artificial Sequence
  dgRNA
  Tcf20
ggcgaaggagggatc

SEQ ID NO: 66228 - DNA, 15 bp, Artificial Sequence
  dgRNA
  Tcf20
aggtgtgatccggca

SEQ ID NO: 66229 - DNA, 15 bp, Artificial Sequence
  dgRNA
  Lat
cctttcctagtggac

SEQ ID NO: 66230 - DNA, 15 bp, Artificial Sequence
  dgRNA
  Lat
ttcccacaactgggt

SEQ ID NO: 66231 - DNA, 15 bp, Artificial Sequence
  dgRNA
  Lat
gcttcctgtcgcacg

SEQ ID NO: 66232 - DNA, 15 bp, Artificial Sequence
  dgRNA
  Lat
tcctgtcgcacgcgg

SEQ ID NO: 66233 - DNA, 15 bp, Artificial Sequence
  dgRNA
  Esp3
gtgtattgacactgg

SEQ ID NO: 66234 - DNA, 15 bp, Artificial Sequence
  dgRNA
  Scaf4
gcgcgcgacaacgcg

SEQ ID NO: 66235 - DNA, 15 bp, Artificial Sequence
  dgRNA
  Scaf4
gcggtcacacgctag

SEQ ID NO: 66236 - DNA, 15 bp, Artificial Sequence
  dgRNA
  Scaf4
cacacgctagcggct

SEQ ID NO: 66237 - DNA, 15 bp, Artificial Sequence
  dgRNA
  Scaf4
ctagcggctcggcgc

SEQ ID NO: 66238 - DNA, 15 bp, Artificial Sequence
  dgRNA
  Rmdn1
acccggagttatttc

SEQ ID NO: 66239 - DNA, 15 bp, Artificial Sequence
  dgRNA
  Rmdn1
gttatttccggtctc

SEQ ID NO: 66240 - DNA, 15 bp, Artificial Sequence
  dgRNA
  Rmdn1
ggtctctggaaaccg

SEQ ID NO: 66241 - DNA, 15 bp, Artificial Sequence
  dgRNA
  Rmdn1
ccggaagctgcgggc

SEQ ID NO: 66242 - DNA, 15 bp, Artificial Sequence
  dgRNA
  Spop
tccgcccaaattccc

SEQ ID NO: 66243 - DNA, 15 bp, Artificial Sequence
  dgRNA
  Spop
caaattcccgggccc

SEQ ID NO: 66244 - DNA, 15 bp, Artificial Sequence
  dgRNA
  Spop
cgacgcttgcgcact

SEQ ID NO: 66245 - DNA, 15 bp, Artificial Sequence
  dgRNA
  Spop
gacgcttgcgcacta

SEQ ID NO: 66246 - DNA, 15 bp, Artificial Sequence
  dgRNA
  Diaph1
cggtactccccgctg

SEQ ID NO: 66247 - DNA, 15 bp, Artificial Sequence
  dgRNA
  Diaph1
ctccccgctgtggcc

SEQ ID NO: 66248 - DNA, 15 bp, Artificial Sequence
  dgRNA
  Diaph1
ccgccccctggcggt

SEQ ID NO: 66249 - DNA, 15 bp, Artificial Sequence
  dgRNA
  Diaph1
agtaccgccccctgg

SEQ ID NO: 66250 - DNA, 15 bp, Artificial Sequence
  dgRNA
  Rif1
tctctagccccgggc

SEQ ID NO: 66251 - DNA, 15 bp, Artificial Sequence
  dgRNA
  Rif1
gatacacaccccccg

SEQ ID NO: 66252 - DNA, 15 bp, Artificial Sequence
  dgRNA
  Rif1
ccccgaggtgctccg

SEQ ID NO: 66253 - DNA, 15 bp, Artificial Sequence
  dgRNA
  Rif1
cccgaggtgctccgg

SEQ ID NO: 66254 - DNA, 15 bp, Artificial Sequence
  dgRNA
  Kcnc1
tccccaccgagcaag

SEQ ID NO: 66255 - DNA, 15 bp, Artificial Sequence
  dgRNA
  Kcnc1
agcaagaggcaacga

SEQ ID NO: 66256 - DNA, 15 bp, Artificial Sequence
  dgRNA
  Kcnc1
gcaagaggcaacgaa

SEQ ID NO: 66257 - DNA, 15 bp, Artificial Sequence
  dgRNA
  Kcnc1
gaggcaacgaagggc

SEQ ID NO: 66258 - DNA, 15 bp, Artificial Sequence
  dgRNA
  Smim10l1
ttgcatgcaaaaagc

SEQ ID NO: 66259 - DNA, 15 bp, Artificial Sequence
  dgRNA
  Smim10l1
gccctccacaaaagt

SEQ ID NO: 66260 - DNA, 15 bp, Artificial Sequence
  dgRNA
  Smim10l1
acccacttttgtgga

SEQ ID NO: 66261 - DNA, 15 bp, Artificial Sequence
  dgRNA
  Smim10l1
aattacccacttttg

SEQ ID NO: 66262 - DNA, 15 bp, Artificial Sequence
  dgRNA
  Drd4
aaactagccccgatg

SEQ ID NO: 66263 - DNA, 15 bp, Artificial Sequence
  dgRNA
  Drd4
aactagccccgatga

SEQ ID NO: 66264 - DNA, 15 bp, Artificial Sequence
  dgRNA
  Drd4
actagccccgatgag

SEQ ID NO: 66265 - DNA, 15 bp, Artificial Sequence
  dgRNA
  Drd4
cagaaattcaagccg

SEQ ID NO: 66266 - DNA, 15 bp, Artificial Sequence
  dgRNA
  1700074P13Rik
tcacctctcttggtc

SEQ ID NO: 66267 - DNA, 15 bp, Artificial Sequence
  dgRNA
  1700074P13Rik
accacggttaatacc

SEQ ID NO: 66268 - DNA, 15 bp, Artificial Sequence
  dgRNA
  1700074P13Rik
cccggcaacgtctgc

SEQ ID NO: 66269 - DNA, 15 bp, Artificial Sequence
  dgRNA
  1700074P13Rik
tatcgcgatgggtac

SEQ ID NO: 66270 - DNA, 15 bp, Artificial Sequence
  dgRNA
  Nfatc3
actacaacttccgag

SEQ ID NO: 66271 - DNA, 15 bp, Artificial Sequence
  dgRNA
  Nfatc3
ctacaacttccgaga

SEQ ID NO: 66272 - DNA, 15 bp, Artificial Sequence
  dgRNA
  Nfatc3
cttccgagagggagc

SEQ ID NO: 66273 - DNA, 15 bp, Artificial Sequence
  dgRNA
  Nfatc3
acttcctcctcgcag

SEQ ID NO: 66274 - DNA, 15 bp, Artificial Sequence
  dgRNA
  Snap25
cggccatctttgatg

SEQ ID NO: 66275 - DNA, 15 bp, Artificial Sequence
  dgRNA
  H2-T3
tccaagtcccggaag

SEQ ID NO: 66276 - DNA, 15 bp, Artificial Sequence
  dgRNA
  H2-T3
ccggaagtggctgtc

SEQ ID NO: 66277 - DNA, 15 bp, Artificial Sequence
  dgRNA
  H2-T3
cggaagtggctgtca

SEQ ID NO: 66278 - DNA, 15 bp, Artificial Sequence
  dgRNA
  H2-T3
ggcgggggattaggt

SEQ ID NO: 66279 - DNA, 15 bp, Artificial Sequence
  dgRNA
  Olfr116
atttatagtaggagc

SEQ ID NO: 66280 - DNA, 15 bp, Artificial Sequence
  dgRNA
  Spag9
atgacgtcatcgctt

SEQ ID NO: 66281 - DNA, 15 bp, Artificial Sequence
  dgRNA
  Ralyl
ataactaacattggt

SEQ ID NO: 66282 - DNA, 15 bp, Artificial Sequence
  dgRNA
  Ralyl
taactaacattggtt

SEQ ID NO: 66283 - DNA, 15 bp, Artificial Sequence
  dgRNA
  Ralyl
aactaacattggttg

SEQ ID NO: 66284 - DNA, 15 bp, Artificial Sequence
  dgRNA
  Ralyl
agtagttacatgcag

SEQ ID NO: 66285 - DNA, 15 bp, Artificial Sequence
  dgRNA
  Zranb2
gccccagtaaaccct

SEQ ID NO: 66286 - DNA, 15 bp, Artificial Sequence
  dgRNA
  Zranb2
caacgcgcaagcccg

SEQ ID NO: 66287 - DNA, 15 bp, Artificial Sequence
  dgRNA
  Zranb2
aacgcgcaagcccgt

SEQ ID NO: 66288 - DNA, 15 bp, Artificial Sequence
  dgRNA
  Zranb2
gggtccttcggcctg

SEQ ID NO: 66289 - DNA, 15 bp, Artificial Sequence
  dgRNA
  C130050O18Rik
gggaccttctgcgag

SEQ ID NO: 66290 - DNA, 15 bp, Artificial Sequence
  dgRNA
  C130050O18Rik
ctggccactcgcaga

SEQ ID NO: 66291 - DNA, 15 bp, Artificial Sequence
  dgRNA
  C130050O18Rik
cttgcagaagtgtgc

SEQ ID NO: 66292 - DNA, 15 bp, Artificial Sequence
  dgRNA
  C130050O18Rik
ggcctatgtctgagg

SEQ ID NO: 66293 - DNA, 15 bp, Artificial Sequence
  dgRNA
  Myoz3
gcaagggcccgctgc

SEQ ID NO: 66294 - DNA, 15 bp, Artificial Sequence
  dgRNA
  Myoz3
caagggcccgctgcc

SEQ ID NO: 66295 - DNA, 15 bp, Artificial Sequence
  dgRNA
  Myoz3
aagggcccgctgccg

SEQ ID NO: 66296 - DNA, 15 bp, Artificial Sequence
  dgRNA
  Myoz3
agtgctttaagcatc

SEQ ID NO: 66297 - DNA, 15 bp, Artificial Sequence
  dgRNA
  Zfp580
tgaatggcacgcagc

SEQ ID NO: 66298 - DNA, 15 bp, Artificial Sequence
  dgRNA
  Zfp580
gcaggtccttctcgt

SEQ ID NO: 66299 - DNA, 15 bp, Artificial Sequence
  dgRNA
  Zfp580
ccttcgtgtgtgtag

SEQ ID NO: 66300 - DNA, 15 bp, Artificial Sequence
  dgRNA
  Zfp580
cttcgtgtgtgtagc

SEQ ID NO: 66301 - DNA, 15 bp, Artificial Sequence
  dgRNA
  Cox4i2
ctgaggtccctactc

SEQ ID NO: 66302 - DNA, 15 bp, Artificial Sequence
  dgRNA
  Cox4i2
gtccctactctggtg

SEQ ID NO: 66303 - DNA, 15 bp, Artificial Sequence
  dgRNA
  Cox4i2
ctgcaaaagcgaccg

SEQ ID NO: 66304 - DNA, 15 bp, Artificial Sequence
  dgRNA
  Cox4i2
aaagcgaccgaggcg

SEQ ID NO: 66305 - DNA, 15 bp, Artificial Sequence
  dgRNA
  Ddx55
atcgcggccaagcga

SEQ ID NO: 66306 - DNA, 15 bp, Artificial Sequence
  dgRNA
  Ddx55
catcgcggccaagcg

SEQ ID NO: 66307 - DNA, 15 bp, Artificial Sequence
  dgRNA
  Ddx55
gcacataggacatcg

SEQ ID NO: 66308 - DNA, 15 bp, Artificial Sequence
  dgRNA
  Acvrl1
gggcggagccaactc

SEQ ID NO: 66309 - DNA, 15 bp, Artificial Sequence
  dgRNA
  Olfr881
cttaatcatatattg

SEQ ID NO: 66310 - DNA, 15 bp, Artificial Sequence
  dgRNA
  Olfr881
attgagggaataagt

SEQ ID NO: 66311 - DNA, 15 bp, Artificial Sequence
  dgRNA
  Olfr881
tatacagggcaccaa

SEQ ID NO: 66312 - DNA, 15 bp, Artificial Sequence
  dgRNA
  Slc7a14
agcatagaactgccc

SEQ ID NO: 66313 - DNA, 15 bp, Artificial Sequence
  dgRNA
  Slc7a14
gctggaggccgcacc

SEQ ID NO: 66314 - DNA, 15 bp, Artificial Sequence
  dgRNA
  Slc7a14
gaggccgcacctgga

SEQ ID NO: 66315 - DNA, 15 bp, Artificial Sequence
  dgRNA
  Slc7a14
tgagtgacagacccg

SEQ ID NO: 66316 - DNA, 15 bp, Artificial Sequence
  dgRNA
  Phf7
gcgcgcgtcgaggcg

SEQ ID NO: 66317 - DNA, 15 bp, Artificial Sequence
  dgRNA
  Phf7
cgcgcgtcgaggcga

SEQ ID NO: 66318 - DNA, 15 bp, Artificial Sequence
  dgRNA
  Phf7
ggcgcgcacgtgcgg

SEQ ID NO: 66319 - DNA, 15 bp, Artificial Sequence
  dgRNA
  Phf7
gcgcgcacgtgcgga

SEQ ID NO: 66320 - DNA, 15 bp, Artificial Sequence
  dgRNA
  Fcho1
gttgcctagggctac

SEQ ID NO: 66321 - DNA, 15 bp, Artificial Sequence
  dgRNA
  Fcho1
agggctacaggacta

SEQ ID NO: 66322 - DNA, 15 bp, Artificial Sequence
  dgRNA
  Fcho1
ctacaggactaaggc

SEQ ID NO: 66323 - DNA, 15 bp, Artificial Sequence
  dgRNA
  Fcho1
gacttgctcctgatc

SEQ ID NO: 66324 - DNA, 15 bp, Artificial Sequence
  dgRNA
  Erlec1
gcccagccgtctgca

SEQ ID NO: 66325 - DNA, 15 bp, Artificial Sequence
  dgRNA
  Erlec1
gtctgcaaggagacg

SEQ ID NO: 66326 - DNA, 15 bp, Artificial Sequence
  dgRNA
  Erlec1
tgcaaggagacgtgg

SEQ ID NO: 66327 - DNA, 15 bp, Artificial Sequence
  dgRNA
  Erlec1
aaggagacgtggcgg

SEQ ID NO: 66328 - DNA, 15 bp, Artificial Sequence
  dgRNA
  Stip1
gcctagccctgaaat

SEQ ID NO: 66329 - DNA, 15 bp, Artificial Sequence
  dgRNA
  Stip1
tagccctgaaatagg

SEQ ID NO: 66330 - DNA, 15 bp, Artificial Sequence
  dgRNA
  Stip1
aggcgggacttgccg

SEQ ID NO: 66331 - DNA, 15 bp, Artificial Sequence
  dgRNA
  Stip1
gcggagtgtccaatc

SEQ ID NO: 66332 - DNA, 15 bp, Artificial Sequence
  dgRNA
  Tmem141
gttaggcctggttcg

SEQ ID NO: 66333 - DNA, 15 bp, Artificial Sequence
  dgRNA
  Tmem141
cccatcagaagctcg

SEQ ID NO: 66334 - DNA, 15 bp, Artificial Sequence
  dgRNA
  Tmem141
gaagctcgcggttat

SEQ ID NO: 66335 - DNA, 15 bp, Artificial Sequence
  dgRNA
  Tmem141
tcccgccccctaagc

SEQ ID NO: 66336 - DNA, 15 bp, Artificial Sequence
  dgRNA
  Arap1
ctcccattggtcggg

SEQ ID NO: 66337 - DNA, 15 bp, Artificial Sequence
  dgRNA
  Arap1
tcccattggtcggga

SEQ ID NO: 66338 - DNA, 15 bp, Artificial Sequence
  dgRNA
  Arap1
attggtcgggagggc

SEQ ID NO: 66339 - DNA, 15 bp, Artificial Sequence
  dgRNA
  Arap1
ttggtcgggagggct

SEQ ID NO: 66340 - DNA, 15 bp, Artificial Sequence
  dgRNA
  Rpl7l1
gaccttagaagggat

SEQ ID NO: 66341 - DNA, 15 bp, Artificial Sequence
  dgRNA
  Rpl7l1
tttttgccggaatcc

SEQ ID NO: 66342 - DNA, 15 bp, Artificial Sequence
  dgRNA
  Rpl7l1
cgctcacattcgcta

SEQ ID NO: 66343 - DNA, 15 bp, Artificial Sequence
  dgRNA
  Rpl7l1
tcgctaaggaatctc

SEQ ID NO: 66344 - DNA, 15 bp, Artificial Sequence
  dgRNA
  Slc16a7
atcttggatatttgc

SEQ ID NO: 66345 - DNA, 15 bp, Artificial Sequence
  dgRNA
  Slc16a7
gtgagccatagatct

SEQ ID NO: 66346 - DNA, 15 bp, Artificial Sequence
  dgRNA
  Adcy1
cccgggcgctgagtt

SEQ ID NO: 66347 - DNA, 15 bp, Artificial Sequence
  dgRNA
  Adcy1
gcgctgagttgggcg

SEQ ID NO: 66348 - DNA, 15 bp, Artificial Sequence
  dgRNA
  Adcy1
ctgtccgcccaggat

SEQ ID NO: 66349 - DNA, 15 bp, Artificial Sequence
  dgRNA
  Adcy1
tgtccgcccaggatc

SEQ ID NO: 66350 - DNA, 15 bp, Artificial Sequence
  dgRNA
  4930578C19Rik
agccgccccaagcag

SEQ ID NO: 66351 - DNA, 15 bp, Artificial Sequence
  dgRNA
  4930578C19Rik
gcggctgcctctgtc

SEQ ID NO: 66352 - DNA, 15 bp, Artificial Sequence
  dgRNA
  4930578C19Rik
ctaatggggctgggc

SEQ ID NO: 66353 - DNA, 15 bp, Artificial Sequence
  dgRNA
  4930578C19Rik
agctagcagctaatg

SEQ ID NO: 66354 - DNA, 15 bp, Artificial Sequence
  dgRNA
  Brwd3
taggcaaccccaggc

SEQ ID NO: 66355 - DNA, 15 bp, Artificial Sequence
  dgRNA
  Brwd3
ggccggcttagctgc

SEQ ID NO: 66356 - DNA, 15 bp, Artificial Sequence
  dgRNA
  Brwd3
ttagctgctggaact

SEQ ID NO: 66357 - DNA, 15 bp, Artificial Sequence
  dgRNA
  Brwd3
ccgccttagtgcctc

SEQ ID NO: 66358 - DNA, 15 bp, Artificial Sequence
  dgRNA
  Lyzl1
tgtccacttagttat

SEQ ID NO: 66359 - DNA, 15 bp, Artificial Sequence
  dgRNA
  Lyzl1
cttagttatgggtgt

SEQ ID NO: 66360 - DNA, 15 bp, Artificial Sequence
  dgRNA
  Lyzl1
gtgatatcacttgca

SEQ ID NO: 66361 - DNA, 15 bp, Artificial Sequence
  dgRNA
  Lyzl1
tgatatcacttgcat

SEQ ID NO: 66362 - DNA, 15 bp, Artificial Sequence
  dgRNA
  Hrh1
tcctcgggtctttgc

SEQ ID NO: 66363 - DNA, 15 bp, Artificial Sequence
  dgRNA
  Hrh1
gccggagatcaccag

SEQ ID NO: 66364 - DNA, 15 bp, Artificial Sequence
  dgRNA
  Hrh1
ccggagatcaccagt

SEQ ID NO: 66365 - DNA, 15 bp, Artificial Sequence
  dgRNA
  Hrh1
cggagatcaccagtg

SEQ ID NO: 66366 - DNA, 15 bp, Artificial Sequence
  dgRNA
  Rufy2
ttggcgctgtgcccc

SEQ ID NO: 66367 - DNA, 15 bp, Artificial Sequence
  dgRNA
  Rufy2
tctctgacgctgtca

SEQ ID NO: 66368 - DNA, 15 bp, Artificial Sequence
  dgRNA
  Rufy2
tgacgctgtcagggt

SEQ ID NO: 66369 - DNA, 15 bp, Artificial Sequence
  dgRNA
  Rufy2
tcagggttggtcaaa

SEQ ID NO: 66370 - DNA, 15 bp, Artificial Sequence
  dgRNA
  2310007B03Rik
gagaccatcgcagtg

SEQ ID NO: 66371 - DNA, 15 bp, Artificial Sequence
  dgRNA
  2310007B03Rik
ccaatgacgcttgct

SEQ ID NO: 66372 - DNA, 15 bp, Artificial Sequence
  dgRNA
  2310007B03Rik
tcctctaggggccaa

SEQ ID NO: 66373 - DNA, 15 bp, Artificial Sequence
  dgRNA
  2310007B03Rik
gggccaagggtcgat

SEQ ID NO: 66374 - DNA, 15 bp, Artificial Sequence
  dgRNA
  Ift27
gtctccagagacgct

SEQ ID NO: 66375 - DNA, 15 bp, Artificial Sequence
  dgRNA
  Ift27
tccagagacgctagg

SEQ ID NO: 66376 - DNA, 15 bp, Artificial Sequence
  dgRNA
  Ift27
ctaggcggtgcccag

SEQ ID NO: 66377 - DNA, 15 bp, Artificial Sequence
  dgRNA
  Ift27
cgctttgttccgcga

SEQ ID NO: 66378 - DNA, 15 bp, Artificial Sequence
  dgRNA
  Pdzd3
gtagggcgcaagacc

SEQ ID NO: 66379 - DNA, 15 bp, Artificial Sequence
  dgRNA
  Pdzd3
tagggcgcaagacct

SEQ ID NO: 66380 - DNA, 15 bp, Artificial Sequence
  dgRNA
  Pdzd3
agggcgcaagacctg

SEQ ID NO: 66381 - DNA, 15 bp, Artificial Sequence
  dgRNA
  Pdzd3
gggcgcaagacctgg

SEQ ID NO: 66382 - DNA, 15 bp, Artificial Sequence
  dgRNA
  Iqcf1
tcacatcaatgccgg

SEQ ID NO: 66383 - DNA, 15 bp, Artificial Sequence
  dgRNA
  Pcbd1
ataggtcaggcagtc

SEQ ID NO: 66384 - DNA, 15 bp, Artificial Sequence
  dgRNA
  Pcbd1
tcaaagcttttgccc

SEQ ID NO: 66385 - DNA, 15 bp, Artificial Sequence
  dgRNA
  Pcbd1
agcattgcaagggcg

SEQ ID NO: 66386 - DNA, 15 bp, Artificial Sequence
  dgRNA
  Pcbd1
gttaattattacccg

SEQ ID NO: 66387 - DNA, 15 bp, Artificial Sequence
  dgRNA
  Zfp740
cagcaaaataagttg

SEQ ID NO: 66388 - DNA, 15 bp, Artificial Sequence
  dgRNA
  Zfp740
gcttcgatcgttgtt

SEQ ID NO: 66389 - DNA, 15 bp, Artificial Sequence
  dgRNA
  Zfp740
aagatgttacaccta

SEQ ID NO: 66390 - DNA, 15 bp, Artificial Sequence
  dgRNA
  Zfp740
agatgttacacctaa

SEQ ID NO: 66391 - DNA, 15 bp, Artificial Sequence
  dgRNA
  Snca
gggggggtcgtagga

SEQ ID NO: 66392 - DNA, 15 bp, Artificial Sequence
  dgRNA
  Olfr533
agactgaatctgtat

SEQ ID NO: 66393 - DNA, 15 bp, Artificial Sequence
  dgRNA
  Olfr533
gactgaatctgtata

SEQ ID NO: 66394 - DNA, 15 bp, Artificial Sequence
  dgRNA
  Olfr533
actaaagtaaatagc

SEQ ID NO: 66395 - DNA, 15 bp, Artificial Sequence
  dgRNA
  Olfr533
accaggaacttgttc

SEQ ID NO: 66396 - DNA, 15 bp, Artificial Sequence
  dgRNA
  Cpsf3
cctcggctcgttccc

SEQ ID NO: 66397 - DNA, 15 bp, Artificial Sequence
  dgRNA
  Cpsf3
gttccccggtcgccc

SEQ ID NO: 66398 - DNA, 15 bp, Artificial Sequence
  dgRNA
  Cpsf3
gtcgccccggtctcg

SEQ ID NO: 66399 - DNA, 15 bp, Artificial Sequence
  dgRNA
  Cpsf3
tcgccccggtctcgc

SEQ ID NO: 66400 - DNA, 15 bp, Artificial Sequence
  dgRNA
  Olfr592
cctgttatcccattc

SEQ ID NO: 66401 - DNA, 15 bp, Artificial Sequence
  dgRNA
  Olfr592
ccagaatgggataac

SEQ ID NO: 66402 - DNA, 15 bp, Artificial Sequence
  dgRNA
  Pygo2
gtgacggaccccatc

SEQ ID NO: 66403 - DNA, 15 bp, Artificial Sequence
  dgRNA
  Pygo2
tgacggaccccatct

SEQ ID NO: 66404 - DNA, 15 bp, Artificial Sequence
  dgRNA
  Pygo2
gaccccatctgggct

SEQ ID NO: 66405 - DNA, 15 bp, Artificial Sequence
  dgRNA
  Pygo2
atttggggagctgcg

SEQ ID NO: 66406 - DNA, 15 bp, Artificial Sequence
  dgRNA
  Pou4f1
tcgctcgcccaagca

SEQ ID NO: 66407 - DNA, 15 bp, Artificial Sequence
  dgRNA
  Pou4f1
ccaagcacggcgccg

SEQ ID NO: 66408 - DNA, 15 bp, Artificial Sequence
  dgRNA
  Pou4f1
acggcgccgcggccg

SEQ ID NO: 66409 - DNA, 15 bp, Artificial Sequence
  dgRNA
  Pou4f1
cgcgcgccagacaga

SEQ ID NO: 66410 - DNA, 15 bp, Artificial Sequence
  dgRNA
  4932443I19Rik
actcaagacaaccac

SEQ ID NO: 66411 - DNA, 15 bp, Artificial Sequence
  dgRNA
  4932443I19Rik
gagcccagttcagtc

SEQ ID NO: 66412 - DNA, 15 bp, Artificial Sequence
  dgRNA
  4932443I19Rik
atgtgacggttgcca

SEQ ID NO: 66413 - DNA, 15 bp, Artificial Sequence
  dgRNA
  Bend7
tcccaacggaaagtt

SEQ ID NO: 66414 - DNA, 15 bp, Artificial Sequence
  dgRNA
  Bend7
cggaaagttgggctg

SEQ ID NO: 66415 - DNA, 15 bp, Artificial Sequence
  dgRNA
  Bend7
aaagttgggctgcgg

SEQ ID NO: 66416 - DNA, 15 bp, Artificial Sequence
  dgRNA
  Bend7
aagttgggctgcggc

SEQ ID NO: 66417 - DNA, 15 bp, Artificial Sequence
  dgRNA
  Zfp687
aagtagcggcggccg

SEQ ID NO: 66418 - DNA, 15 bp, Artificial Sequence
  dgRNA
  Zfp687
agtagcggcggccgc

SEQ ID NO: 66419 - DNA, 15 bp, Artificial Sequence
  dgRNA
  Zfp687
gtagcggcggccgcg

SEQ ID NO: 66420 - DNA, 15 bp, Artificial Sequence
  dgRNA
  Zfp687
gtggcggctggaacc

SEQ ID NO: 66421 - DNA, 15 bp, Artificial Sequence
  dgRNA
  Wipf1
acctatgaggttttt

SEQ ID NO: 66422 - DNA, 15 bp, Artificial Sequence
  dgRNA
  Wipf1
tccttacatgagctg

SEQ ID NO: 66423 - DNA, 15 bp, Artificial Sequence
  dgRNA
  Wipf1
gccaaaaaacctcat

SEQ ID NO: 66424 - DNA, 15 bp, Artificial Sequence
  dgRNA
  Klra3
tttgctttggtgacg

SEQ ID NO: 66425 - DNA, 15 bp, Artificial Sequence
  dgRNA
  Klra3
gctttggtgacgagg

SEQ ID NO: 66426 - DNA, 15 bp, Artificial Sequence
  dgRNA
  Klra3
ctttggtgacgagga

SEQ ID NO: 66427 - DNA, 15 bp, Artificial Sequence
  dgRNA
  Klra3
tttggtgacgaggag

SEQ ID NO: 66428 - DNA, 15 bp, Artificial Sequence
  dgRNA
  Nqo1
tgggcgggcataagc

SEQ ID NO: 66429 - DNA, 15 bp, Artificial Sequence
  dgRNA
  Nqo1
gttccccgggagcaa

SEQ ID NO: 66430 - DNA, 15 bp, Artificial Sequence
  dgRNA
  Nqo1
ggttccccgggagca

SEQ ID NO: 66431 - DNA, 15 bp, Artificial Sequence
  dgRNA
  Nqo1
tcaaaagggttcccc

SEQ ID NO: 66432 - DNA, 15 bp, Artificial Sequence
  dgRNA
  Mrap2
tctgttcactggcgg

SEQ ID NO: 66433 - DNA, 15 bp, Artificial Sequence
  dgRNA
  Mrap2
gttcactggcggcgg

SEQ ID NO: 66434 - DNA, 15 bp, Artificial Sequence
  dgRNA
  Mrap2
gcggcggcacggcgg

SEQ ID NO: 66435 - DNA, 15 bp, Artificial Sequence
  dgRNA
  Mrap2
ggcacggcggcggtg

SEQ ID NO: 66436 - DNA, 15 bp, Artificial Sequence
  dgRNA
  Arid3c
tcctcttgtgttgta

SEQ ID NO: 66437 - DNA, 15 bp, Artificial Sequence
  dgRNA
  Arid3c
accctacaacacaag

SEQ ID NO: 66438 - DNA, 15 bp, Artificial Sequence
  dgRNA
  Gemin5
gttggcgggttccac

SEQ ID NO: 66439 - DNA, 15 bp, Artificial Sequence
  dgRNA
  Gemin5
gaatttagttccagg

SEQ ID NO: 66440 - DNA, 15 bp, Artificial Sequence
  dgRNA
  Gemin5
gttccaggcggcgca

SEQ ID NO: 66441 - DNA, 15 bp, Artificial Sequence
  dgRNA
  Gemin5
ttccaggcggcgcac

SEQ ID NO: 66442 - DNA, 15 bp, Artificial Sequence
  dgRNA
  Gm12942
agattcctctagcac

SEQ ID NO: 66443 - DNA, 15 bp, Artificial Sequence
  dgRNA
  Gm12942
tcctctagcacgggt

SEQ ID NO: 66444 - DNA, 15 bp, Artificial Sequence
  dgRNA
  Gm12942
cacgggtgggtttga

SEQ ID NO: 66445 - DNA, 15 bp, Artificial Sequence
  dgRNA
  Gm12942
gaaggccagatcgcg

SEQ ID NO: 66446 - DNA, 15 bp, Artificial Sequence
  dgRNA
  Ly9
gatctggatgtgctt

SEQ ID NO: 66447 - DNA, 15 bp, Artificial Sequence
  dgRNA
  Ly9
attgtaaaccagtgc

SEQ ID NO: 66448 - DNA, 15 bp, Artificial Sequence
  dgRNA
  Tmem233
ggtctctaggtgtga

SEQ ID NO: 66449 - DNA, 15 bp, Artificial Sequence
  dgRNA
  Tmem233
gcctccccgggtgac

SEQ ID NO: 66450 - DNA, 15 bp, Artificial Sequence
  dgRNA
  Tmem233
aggctccccgcctct

SEQ ID NO: 66451 - DNA, 15 bp, Artificial Sequence
  dgRNA
  Tmem233
agcccagccgcgtgc

SEQ ID NO: 66452 - DNA, 15 bp, Artificial Sequence
  dgRNA
  3110001I22Rik
aagctagctaaatac

SEQ ID NO: 66453 - DNA, 15 bp, Artificial Sequence
  dgRNA
  3110001I22Rik
ggaacgcaatccagc

SEQ ID NO: 66454 - DNA, 15 bp, Artificial Sequence
  dgRNA
  3110001I22Rik
tggaacctccagacc

SEQ ID NO: 66455 - DNA, 15 bp, Artificial Sequence
  dgRNA
  3110001I22Rik
ggaacctccagacct

SEQ ID NO: 66456 - DNA, 15 bp, Artificial Sequence
  dgRNA
  Mall
gaaagaccctctgcg

SEQ ID NO: 66457 - DNA, 15 bp, Artificial Sequence
  dgRNA
  Mall
gaccctctgcgaggc

SEQ ID NO: 66458 - DNA, 15 bp, Artificial Sequence
  dgRNA
  Mall
gggcccccgctctac

SEQ ID NO: 66459 - DNA, 15 bp, Artificial Sequence
  dgRNA
  Mall
cgtccctccgaccga

SEQ ID NO: 66460 - DNA, 15 bp, Artificial Sequence
  dgRNA
  Cda
tccgggctcccgccc

SEQ ID NO: 66461 - DNA, 15 bp, Artificial Sequence
  dgRNA
  Cda
ccgggctcccgccct

SEQ ID NO: 66462 - DNA, 15 bp, Artificial Sequence
  dgRNA
  Cda
agcatcccgccagcc

SEQ ID NO: 66463 - DNA, 15 bp, Artificial Sequence
  dgRNA
  Cda
gcatcccgccagcct

SEQ ID NO: 66464 - DNA, 15 bp, Artificial Sequence
  dgRNA
  Bbs12
ccgctctcccctccg

SEQ ID NO: 66465 - DNA, 15 bp, Artificial Sequence
  dgRNA
  Bbs12
gcgtttgctcccgac

SEQ ID NO: 66466 - DNA, 15 bp, Artificial Sequence
  dgRNA
  Bbs12
tttgctcccgacagg

SEQ ID NO: 66467 - DNA, 15 bp, Artificial Sequence
  dgRNA
  Bbs12
gaccattgcgcccaa

SEQ ID NO: 66468 - DNA, 15 bp, Artificial Sequence
  dgRNA
  Trmt2b
gagccccgcagcact

SEQ ID NO: 66469 - DNA, 15 bp, Artificial Sequence
  dgRNA
  Trmt2b
ggagcgctgcgcacc

SEQ ID NO: 66470 - DNA, 15 bp, Artificial Sequence
  dgRNA
  Trmt2b
gggccagtcacttcc

SEQ ID NO: 66471 - DNA, 15 bp, Artificial Sequence
  dgRNA
  1700001C19Rik
atttgatgtcgcaaa

SEQ ID NO: 66472 - DNA, 15 bp, Artificial Sequence
  dgRNA
  1700001C19Rik
gatgtcgcaaatggc

SEQ ID NO: 66473 - DNA, 15 bp, Artificial Sequence
  dgRNA
  1700001C19Rik
gcaatctgctaacag

SEQ ID NO: 66474 - DNA, 15 bp, Artificial Sequence
  dgRNA
  1700001C19Rik
gaccctttgaatcaa

SEQ ID NO: 66475 - DNA, 15 bp, Artificial Sequence
  dgRNA
  Banp
tacgtcctctttgat

SEQ ID NO: 66476 - DNA, 15 bp, Artificial Sequence
  dgRNA
  Banp
gtacgtcctctttga

SEQ ID NO: 66477 - DNA, 15 bp, Artificial Sequence
  dgRNA
  Nutm1
gacacccaacaatca

SEQ ID NO: 66478 - DNA, 15 bp, Artificial Sequence
  dgRNA
  Nutm1
gtatcaaattcacgg

SEQ ID NO: 66479 - DNA, 15 bp, Artificial Sequence
  dgRNA
  Nutm1
tatcaaattcacgga

SEQ ID NO: 66480 - DNA, 15 bp, Artificial Sequence
  dgRNA
  Nutm1
tgataccatgattgt

SEQ ID NO: 66481 - DNA, 15 bp, Artificial Sequence
  dgRNA
  Adamts19
catcacctaattcgc

SEQ ID NO: 66482 - DNA, 15 bp, Artificial Sequence
  dgRNA
  Adamts19
atcacctaattcgct

SEQ ID NO: 66483 - DNA, 15 bp, Artificial Sequence
  dgRNA
  Adamts19
tcacctaattcgctg

SEQ ID NO: 66484 - DNA, 15 bp, Artificial Sequence
  dgRNA
  Adamts19
aattcgctggggagc

SEQ ID NO: 66485 - DNA, 15 bp, Artificial Sequence
  dgRNA
  Lexm
gtgaatgataacgtc

SEQ ID NO: 66486 - DNA, 15 bp, Artificial Sequence
  dgRNA
  Lexm
tgaatgataacgtca

SEQ ID NO: 66487 - DNA, 15 bp, Artificial Sequence
  dgRNA
  Lexm
gaatgataacgtcag

SEQ ID NO: 66488 - DNA, 15 bp, Artificial Sequence
  dgRNA
  Lexm
aatgataacgtcagg

SEQ ID NO: 66489 - DNA, 15 bp, Artificial Sequence
  dgRNA
  Ccl27a
acccatagaatgcga

SEQ ID NO: 66490 - DNA, 15 bp, Artificial Sequence
  dgRNA
  Ccl27a
ttaacggtccgtttc

SEQ ID NO: 66491 - DNA, 15 bp, Artificial Sequence
  dgRNA
  Ccl27a
aacggtccgtttccg

SEQ ID NO: 66492 - DNA, 15 bp, Artificial Sequence
  dgRNA
  Ccl27a
ggtccgtttccgggg

SEQ ID NO: 66493 - DNA, 15 bp, Artificial Sequence
  dgRNA
  Chd4
attatgggttatcta

SEQ ID NO: 66494 - DNA, 15 bp, Artificial Sequence
  dgRNA
  Chd4
ttatgggttatctaa

SEQ ID NO: 66495 - DNA, 15 bp, Artificial Sequence
  dgRNA
  Chd4
tgggttatctaaggg

SEQ ID NO: 66496 - DNA, 15 bp, Artificial Sequence
  dgRNA
  Chd4
gggttatctaaggga

SEQ ID NO: 66497 - DNA, 15 bp, Artificial Sequence
  dgRNA
  Zfp189
ttcgcttgccattta

SEQ ID NO: 66498 - DNA, 15 bp, Artificial Sequence
  dgRNA
  Zfp189
gccatttacggaaga

SEQ ID NO: 66499 - DNA, 15 bp, Artificial Sequence
  dgRNA
  Zfp189
atttacggaagaagg

SEQ ID NO: 66500 - DNA, 15 bp, Artificial Sequence
  dgRNA
  Zfp189
tacggaagaaggcgg

SEQ ID NO: 66501 - DNA, 15 bp, Artificial Sequence
  dgRNA
  Poll
gcagtgccgtcttct

SEQ ID NO: 66502 - DNA, 15 bp, Artificial Sequence
  dgRNA
  Poll
atcttccctccgccc

SEQ ID NO: 66503 - DNA, 15 bp, Artificial Sequence
  dgRNA
  Poll
cgcccaggaacgcgc

SEQ ID NO: 66504 - DNA, 15 bp, Artificial Sequence
  dgRNA
  Poll
gcccaggaacgcgcc

SEQ ID NO: 66505 - DNA, 15 bp, Artificial Sequence
  dgRNA
  Myo1b
ttgggcacccaaact

SEQ ID NO: 66506 - DNA, 15 bp, Artificial Sequence
  dgRNA
  Myo1b
aaacttggacctagg

SEQ ID NO: 66507 - DNA, 15 bp, Artificial Sequence
  dgRNA
  Myo1b
aacttggacctagga

SEQ ID NO: 66508 - DNA, 15 bp, Artificial Sequence
  dgRNA
  Myo1b
tggacctaggagggt

SEQ ID NO: 66509 - DNA, 15 bp, Artificial Sequence
  dgRNA
  Nnat
cattgcgcccagcag

SEQ ID NO: 66510 - DNA, 15 bp, Artificial Sequence
  dgRNA
  Vax2
ttgcgctgcgcctac

SEQ ID NO: 66511 - DNA, 15 bp, Artificial Sequence
  dgRNA
  Vax2
gcgcccaatcgccga

SEQ ID NO: 66512 - DNA, 15 bp, Artificial Sequence
  dgRNA
  Vax2
cgcccaatcgccgac

SEQ ID NO: 66513 - DNA, 15 bp, Artificial Sequence
  dgRNA
  Vax2
gcccaatcgccgacg

SEQ ID NO: 66514 - DNA, 15 bp, Artificial Sequence
  dgRNA
  St6galnac3
caggttaagcagatc

SEQ ID NO: 66515 - DNA, 15 bp, Artificial Sequence
  dgRNA
  St6galnac3
aggttaagcagatct

SEQ ID NO: 66516 - DNA, 15 bp, Artificial Sequence
  dgRNA
  St6galnac3
aagtagtagcagcgg

SEQ ID NO: 66517 - DNA, 15 bp, Artificial Sequence
  dgRNA
  St6galnac3
agtagcaagcagttg

SEQ ID NO: 66518 - DNA, 15 bp, Artificial Sequence
  dgRNA
  Pygo2
ccccaccggacaagc

SEQ ID NO: 66519 - DNA, 15 bp, Artificial Sequence
  dgRNA
  Pygo2
caccggacaagctgg

SEQ ID NO: 66520 - DNA, 15 bp, Artificial Sequence
  dgRNA
  Pygo2
accggacaagctgga

SEQ ID NO: 66521 - DNA, 15 bp, Artificial Sequence
  dgRNA
  Pygo2
cgcgccgcccagcac

SEQ ID NO: 66522 - DNA, 15 bp, Artificial Sequence
  dgRNA
  Cyp1a2
tgatatcaagtgacc

SEQ ID NO: 66523 - DNA, 15 bp, Artificial Sequence
  dgRNA
  Cyp1a2
gatatcaagtgaccc

SEQ ID NO: 66524 - DNA, 15 bp, Artificial Sequence
  dgRNA
  Cyp1a2
agtgacccgggcacc

SEQ ID NO: 66525 - DNA, 15 bp, Artificial Sequence
  dgRNA
  Cyp1a2
gtgacccgggcacct

SEQ ID NO: 66526 - DNA, 15 bp, Artificial Sequence
  dgRNA
  Txn1
gccccttataaacta

SEQ ID NO: 66527 - DNA, 15 bp, Artificial Sequence
  dgRNA
  Txn1
actaaggttcttgtt

SEQ ID NO: 66528 - DNA, 15 bp, Artificial Sequence
  dgRNA
  Txn1
cggcagcttagagtg

SEQ ID NO: 66529 - DNA, 15 bp, Artificial Sequence
  dgRNA
  Txn1
gcttagagtggggcg

SEQ ID NO: 66530 - DNA, 15 bp, Artificial Sequence
  dgRNA
  Dzip3
tcgcctccgacttaa

SEQ ID NO: 66531 - DNA, 15 bp, Artificial Sequence
  dgRNA
  Dzip3
acttcaagcaggcgg

SEQ ID NO: 66532 - DNA, 15 bp, Artificial Sequence
  dgRNA
  Dzip3
tccatgccgacgagc

SEQ ID NO: 66533 - DNA, 15 bp, Artificial Sequence
  dgRNA
  Dzip3
aggccgttaagtcgg

SEQ ID NO: 66534 - DNA, 15 bp, Artificial Sequence
  dgRNA
  Mthfr
tcccgcccctttgcg

SEQ ID NO: 66535 - DNA, 15 bp, Artificial Sequence
  dgRNA
  Mthfr
cccagcttcagctcg

SEQ ID NO: 66536 - DNA, 15 bp, Artificial Sequence
  dgRNA
  Mthfr
acagctccgcccagt

SEQ ID NO: 66537 - DNA, 15 bp, Artificial Sequence
  dgRNA
  Mthfr
cagctccgcccagtt

SEQ ID NO: 66538 - DNA, 15 bp, Artificial Sequence
  dgRNA
  Olfr1475
atcctggggaacttc

SEQ ID NO: 66539 - DNA, 15 bp, Artificial Sequence
  dgRNA
  Cyb5d1
cagtaggctcgaagc

SEQ ID NO: 66540 - DNA, 15 bp, Artificial Sequence
  dgRNA
  Cyb5d1
ctcgaagccggaatc

SEQ ID NO: 66541 - DNA, 15 bp, Artificial Sequence
  dgRNA
  Cyb5d1
ccggaatgcttccgg

SEQ ID NO: 66542 - DNA, 15 bp, Artificial Sequence
  dgRNA
  Cyb5d1
aactactgtggccgg

SEQ ID NO: 66543 - DNA, 15 bp, Artificial Sequence
  dgRNA
  Rad18
ctctcgggatccaag

SEQ ID NO: 66544 - DNA, 15 bp, Artificial Sequence
  dgRNA
  Rad18
cgcctgcatcgctcc

SEQ ID NO: 66545 - DNA, 15 bp, Artificial Sequence
  dgRNA
  Rad18
ctccaggctacgccc

SEQ ID NO: 66546 - DNA, 15 bp, Artificial Sequence
  dgRNA
  Rad18
ggcgtttggacctct

SEQ ID NO: 66547 - DNA, 15 bp, Artificial Sequence
  dgRNA
  Myl10
acacaccggcagcca

SEQ ID NO: 66548 - DNA, 15 bp, Artificial Sequence
  dgRNA
  Myl10
cacaccggcagccag

SEQ ID NO: 66549 - DNA, 15 bp, Artificial Sequence
  dgRNA
  Myl10
acatgagctgagcgc

SEQ ID NO: 66550 - DNA, 15 bp, Artificial Sequence
  dgRNA
  Zc3h14
gttgagtggacaata

SEQ ID NO: 66551 - DNA, 15 bp, Artificial Sequence
  dgRNA
  Zc3h14
tacttgcttaattta

SEQ ID NO: 66552 - DNA, 15 bp, Artificial Sequence
  dgRNA
  Zc3h14
gcttaatttatggaa

SEQ ID NO: 66553 - DNA, 15 bp, Artificial Sequence
  dgRNA
  Zc3h14
actcaactgtaattt

SEQ ID NO: 66554 - DNA, 15 bp, Artificial Sequence
  dgRNA
  Ptprz1
gattctaagccccag

SEQ ID NO: 66555 - DNA, 15 bp, Artificial Sequence
  dgRNA
  Ptprz1
attctaagccccagc

SEQ ID NO: 66556 - DNA, 15 bp, Artificial Sequence
  dgRNA
  Ptprz1
gctgctgcgcgaccc

SEQ ID NO: 66557 - DNA, 15 bp, Artificial Sequence
  dgRNA
  Ptprz1
tgcgcgtgcccagcc

SEQ ID NO: 66558 - DNA, 15 bp, Artificial Sequence
  dgRNA
  AW146154
taagtactgaccaag

SEQ ID NO: 66559 - DNA, 15 bp, Artificial Sequence
  dgRNA
  AW146154
gtactgaccaagcgg

SEQ ID NO: 66560 - DNA, 15 bp, Artificial Sequence
  dgRNA
  AW146154
accaagcggtggatc

SEQ ID NO: 66561 - DNA, 15 bp, Artificial Sequence
  dgRNA
  AW146154
ccggtcacatgttgt

SEQ ID NO: 66562 - DNA, 15 bp, Artificial Sequence
  dgRNA
  Crb3
cgccacgccccccgc

SEQ ID NO: 66563 - DNA, 15 bp, Artificial Sequence
  dgRNA
  Crb3
gccacgccccccgcc

SEQ ID NO: 66564 - DNA, 15 bp, Artificial Sequence
  dgRNA
  Crb3
ccacgccccccgccg

SEQ ID NO: 66565 - DNA, 15 bp, Artificial Sequence
  dgRNA
  Crb3
catttccgccctctg

SEQ ID NO: 66566 - DNA, 15 bp, Artificial Sequence
  dgRNA
  Zfp763
ctattctaactgcac

SEQ ID NO: 66567 - DNA, 15 bp, Artificial Sequence
  dgRNA
  Zfp763
tattctaactgcact

SEQ ID NO: 66568 - DNA, 15 bp, Artificial Sequence
  dgRNA
  Zfp763
aggcatttaagctca

SEQ ID NO: 66569 - DNA, 15 bp, Artificial Sequence
  dgRNA
  Zfp763
tatctttcctcaatc

SEQ ID NO: 66570 - DNA, 15 bp, Artificial Sequence
  dgRNA
  Irf6
agtccccaggacgat

SEQ ID NO: 66571 - DNA, 15 bp, Artificial Sequence
  dgRNA
  Irf6
cgatcggacacccgc

SEQ ID NO: 66572 - DNA, 15 bp, Artificial Sequence
  dgRNA
  Irf6
gatcggacacccgca

SEQ ID NO: 66573 - DNA, 15 bp, Artificial Sequence
  dgRNA
  Irf6
gacacccgcagggtg

SEQ ID NO: 66574 - DNA, 15 bp, Artificial Sequence
  dgRNA
  Nap1l4
ttttgttggcgacca

SEQ ID NO: 66575 - DNA, 15 bp, Artificial Sequence
  dgRNA
  Kdm1b
tgcagaccacgccca

SEQ ID NO: 66576 - DNA, 15 bp, Artificial Sequence
  dgRNA
  Kdm1b
acgcccagggcgcgc

SEQ ID NO: 66577 - DNA, 15 bp, Artificial Sequence
  dgRNA
  Kdm1b
ccacccaggccgccc

SEQ ID NO: 66578 - DNA, 15 bp, Artificial Sequence
  dgRNA
  Kdm1b
ccccgccccgaagca

SEQ ID NO: 66579 - DNA, 15 bp, Artificial Sequence
  dgRNA
  Adtrp
gagcgtgtcttagta

SEQ ID NO: 66580 - DNA, 15 bp, Artificial Sequence
  dgRNA
  Adtrp
cgtgtcttagtaagg

SEQ ID NO: 66581 - DNA, 15 bp, Artificial Sequence
  dgRNA
  Adtrp
agtaaggtggcgatc

SEQ ID NO: 66582 - DNA, 15 bp, Artificial Sequence
  dgRNA
  Adtrp
gtaaggtggcgatct

SEQ ID NO: 66583 - DNA, 15 bp, Artificial Sequence
  dgRNA
  Pank1
ttgtcgtttgcagag

SEQ ID NO: 66584 - DNA, 15 bp, Artificial Sequence
  dgRNA
  Strada
ggccggttgctggga

SEQ ID NO: 66585 - DNA, 15 bp, Artificial Sequence
  dgRNA
  Strada
aggccggttgctggg

SEQ ID NO: 66586 - DNA, 15 bp, Artificial Sequence
  dgRNA
  Strada
gccaggccggttgct

SEQ ID NO: 66587 - DNA, 15 bp, Artificial Sequence
  dgRNA
  Strada
cgccaggccggttgc

SEQ ID NO: 66588 - DNA, 15 bp, Artificial Sequence
  dgRNA
  Bpifb9b
ggtagagtactcttc

SEQ ID NO: 66589 - DNA, 15 bp, Artificial Sequence
  dgRNA
  Bpifb9b
cagcacaactacctc

SEQ ID NO: 66590 - DNA, 15 bp, Artificial Sequence
  dgRNA
  Bpifb9b
catcgtgacctttaa

SEQ ID NO: 66591 - DNA, 15 bp, Artificial Sequence
  dgRNA
  Bpifb9b
cgtgacctttaaagg

SEQ ID NO: 66592 - DNA, 15 bp, Artificial Sequence
  dgRNA
  Bola2
ctgctacgcttgctc

SEQ ID NO: 66593 - DNA, 15 bp, Artificial Sequence
  dgRNA
  Bola2
ctacgcttgctctgg

SEQ ID NO: 66594 - DNA, 15 bp, Artificial Sequence
  dgRNA
  Bola2
ggcccgcctcctacg

SEQ ID NO: 66595 - DNA, 15 bp, Artificial Sequence
  dgRNA
  Bola2
ccgcgccttcttacc

SEQ ID NO: 66596 - DNA, 15 bp, Artificial Sequence
  dgRNA
  Adhfe1
ccaactgctaacaac

SEQ ID NO: 66597 - DNA, 15 bp, Artificial Sequence
  dgRNA
  Adhfe1
ttacgaaaaacccag

SEQ ID NO: 66598 - DNA, 15 bp, Artificial Sequence
  dgRNA
  Adhfe1
tacgaaaaacccagt

SEQ ID NO: 66599 - DNA, 15 bp, Artificial Sequence
  dgRNA
  Adhfe1
acgaaaaacccagtg

SEQ ID NO: 66600 - DNA, 15 bp, Artificial Sequence
  dgRNA
  1700012P22Rik
gttgttatgccaaga

SEQ ID NO: 66601 - DNA, 15 bp, Artificial Sequence
  dgRNA
  1700012P22Rik
tgttgttatgccaag

SEQ ID NO: 66602 - DNA, 15 bp, Artificial Sequence
  dgRNA
  Kmt2d
gccggggcgctggcc

SEQ ID NO: 66603 - DNA, 15 bp, Artificial Sequence
  dgRNA
  Kmt2d
cgctggccgggccct

SEQ ID NO: 66604 - DNA, 15 bp, Artificial Sequence
  dgRNA
  Kmt2d
ggccctaggactgag

SEQ ID NO: 66605 - DNA, 15 bp, Artificial Sequence
  dgRNA
  Kmt2d
ggccgccccgcgacg

SEQ ID NO: 66606 - DNA, 15 bp, Artificial Sequence
  dgRNA
  Rps9
tcaatgctttagccc

SEQ ID NO: 66607 - DNA, 15 bp, Artificial Sequence
  dgRNA
  Rps9
agcctcgttaattct

SEQ ID NO: 66608 - DNA, 15 bp, Artificial Sequence
  dgRNA
  Rps9
gcctaaccacctcac

SEQ ID NO: 66609 - DNA, 15 bp, Artificial Sequence
  dgRNA
  Rps9
aagcgccgctctagc

SEQ ID NO: 66610 - DNA, 15 bp, Artificial Sequence
  dgRNA
  Vmn2r19
agcagattgtactcc

SEQ ID NO: 66611 - DNA, 15 bp, Artificial Sequence
  dgRNA
  Vmn2r19
gcagattgtactcca

SEQ ID NO: 66612 - DNA, 15 bp, Artificial Sequence
  dgRNA
  Vmn2r19
acgttgataaaaaaa

SEQ ID NO: 66613 - DNA, 15 bp, Artificial Sequence
  dgRNA
  Tekt4
actcatgttcttgcg

SEQ ID NO: 66614 - DNA, 15 bp, Artificial Sequence
  dgRNA
  Tekt4
gcttggccctttaag

SEQ ID NO: 66615 - DNA, 15 bp, Artificial Sequence
  dgRNA
  Tekt4
acatagctgggtaaa

SEQ ID NO: 66616 - DNA, 15 bp, Artificial Sequence
  dgRNA
  Tekt4
gaactgccctcttaa

SEQ ID NO: 66617 - DNA, 15 bp, Artificial Sequence
  dgRNA
  Pigt
gcacctataggtgcg

SEQ ID NO: 66618 - DNA, 15 bp, Artificial Sequence
  dgRNA
  Pigt
cacctataggtgcgc

SEQ ID NO: 66619 - DNA, 15 bp, Artificial Sequence
  dgRNA
  Pigt
cgcccacaccccttc

SEQ ID NO: 66620 - DNA, 15 bp, Artificial Sequence
  dgRNA
  Pigt
tccacgatctgttga

SEQ ID NO: 66621 - DNA, 15 bp, Artificial Sequence
  dgRNA
  Cd8b1
gctttgatgctgtat

SEQ ID NO: 66622 - DNA, 15 bp, Artificial Sequence
  dgRNA
  Cd8b1
attccgcccctgccc

SEQ ID NO: 66623 - DNA, 15 bp, Artificial Sequence
  dgRNA
  Cd8b1
gctcacttacgttcc

SEQ ID NO: 66624 - DNA, 15 bp, Artificial Sequence
  dgRNA
  Cd8b1
ttcaaagagcccacc

SEQ ID NO: 66625 - DNA, 15 bp, Artificial Sequence
  dgRNA
  Ndor1
gcaagcagcccaacc

SEQ ID NO: 66626 - DNA, 15 bp, Artificial Sequence
  dgRNA
  Ndor1
acctggcctggacgc

SEQ ID NO: 66627 - DNA, 15 bp, Artificial Sequence
  dgRNA
  Ndor1
cctggacgccggccc

SEQ ID NO: 66628 - DNA, 15 bp, Artificial Sequence
  dgRNA
  Ndor1
ctggacgccggccct

SEQ ID NO: 66629 - DNA, 15 bp, Artificial Sequence
  dgRNA
  Fbxl3
ccgccctaaactttc

SEQ ID NO: 66630 - DNA, 15 bp, Artificial Sequence
  dgRNA
  Fbxl3
ttccggttttaaccc

SEQ ID NO: 66631 - DNA, 15 bp, Artificial Sequence
  dgRNA
  Fbxl3
tccggttttaaccct

SEQ ID NO: 66632 - DNA, 15 bp, Artificial Sequence
  dgRNA
  Fbxl3
aaggccagccacgtc

SEQ ID NO: 66633 - DNA, 15 bp, Artificial Sequence
  dgRNA
  Lcorl
agccgctcgagctga

SEQ ID NO: 66634 - DNA, 15 bp, Artificial Sequence
  dgRNA
  Lcorl
gctcgagctgacggt

SEQ ID NO: 66635 - DNA, 15 bp, Artificial Sequence
  dgRNA
  Lcorl
ctcgagctgacggtt

SEQ ID NO: 66636 - DNA, 15 bp, Artificial Sequence
  dgRNA
  Lcorl
ggaagtctggacgga

SEQ ID NO: 66637 - DNA, 15 bp, Artificial Sequence
  dgRNA
  Rwdd2a
cagacctcgcagacg

SEQ ID NO: 66638 - DNA, 15 bp, Artificial Sequence
  dgRNA
  Chp1
tccctagcgccacag

SEQ ID NO: 66639 - DNA, 15 bp, Artificial Sequence
  dgRNA
  Chp1
tcgccgctttaagtc

SEQ ID NO: 66640 - DNA, 15 bp, Artificial Sequence
  dgRNA
  Chp1
ccgctttaagtccgg

SEQ ID NO: 66641 - DNA, 15 bp, Artificial Sequence
  dgRNA
  Chp1
gtccggcggctgccc

SEQ ID NO: 66642 - DNA, 15 bp, Artificial Sequence
  dgRNA
  Syvn1
ttggcacccagtccg

SEQ ID NO: 66643 - DNA, 15 bp, Artificial Sequence
  dgRNA
  Syvn1
tttatcgcaaccaat

SEQ ID NO: 66644 - DNA, 15 bp, Artificial Sequence
  dgRNA
  Syvn1
atcgcaaccaatcgg

SEQ ID NO: 66645 - DNA, 15 bp, Artificial Sequence
  dgRNA
  Syvn1
aatcggcggtagcca

SEQ ID NO: 66646 - DNA, 15 bp, Artificial Sequence
  dgRNA
  Pard6g
ggaccgctgtggaga

SEQ ID NO: 66647 - DNA, 15 bp, Artificial Sequence
  dgRNA
  Pard6g
caccaggtaggggcg

SEQ ID NO: 66648 - DNA, 15 bp, Artificial Sequence
  dgRNA
  Pard6g
gtgggcgggtcctga

SEQ ID NO: 66649 - DNA, 15 bp, Artificial Sequence
  dgRNA
  Pard6g
tgggcgggtcctgat

SEQ ID NO: 66650 - DNA, 15 bp, Artificial Sequence
  dgRNA
  Gng13
acaagattgtcaaac

SEQ ID NO: 66651 - DNA, 15 bp, Artificial Sequence
  dgRNA
  Gng13
caagattgtcaaact

SEQ ID NO: 66652 - DNA, 15 bp, Artificial Sequence
  dgRNA
  Gng13
catgtcccaccccag

SEQ ID NO: 66653 - DNA, 15 bp, Artificial Sequence
  dgRNA
  Gng13
agcccaaccctgtaa

SEQ ID NO: 66654 - DNA, 15 bp, Artificial Sequence
  dgRNA
  Col20a1
ataatgacaagttgt

SEQ ID NO: 66655 - DNA, 15 bp, Artificial Sequence
  dgRNA
  Col20a1
aagttgtaggcctct

SEQ ID NO: 66656 - DNA, 15 bp, Artificial Sequence
  dgRNA
  Col20a1
atcctgctggtccat

SEQ ID NO: 66657 - DNA, 15 bp, Artificial Sequence
  dgRNA
  Col20a1
tccttaagtggtgaa

SEQ ID NO: 66658 - DNA, 15 bp, Artificial Sequence
  dgRNA
  Hist1h2bg
cctctgcagccaata

SEQ ID NO: 66659 - DNA, 15 bp, Artificial Sequence
  dgRNA
  Hist1h2bg
caatacaatctaatt

SEQ ID NO: 66660 - DNA, 15 bp, Artificial Sequence
  dgRNA
  Hist1h2bg
aatggtgtcactaac

SEQ ID NO: 66661 - DNA, 15 bp, Artificial Sequence
  dgRNA
  Hist1h2bg
ccttattggctgcag

SEQ ID NO: 66662 - DNA, 15 bp, Artificial Sequence
  dgRNA
  Rnf130
ccctgagagatccac

SEQ ID NO: 66663 - DNA, 15 bp, Artificial Sequence
  dgRNA
  Rnf130
gcgcgcactcgcgcg

SEQ ID NO: 66664 - DNA, 15 bp, Artificial Sequence
  dgRNA
  Rnf130
cgcgcactcgcgcgc

SEQ ID NO: 66665 - DNA, 15 bp, Artificial Sequence
  dgRNA
  Rnf130
ctcgcgcgcgggccg

SEQ ID NO: 66666 - DNA, 15 bp, Artificial Sequence
  dgRNA
  Arhgef15
acccaggggacaata

SEQ ID NO: 66667 - DNA, 15 bp, Artificial Sequence
  dgRNA
  Arhgef15
ttattgtcccctggg

SEQ ID NO: 66668 - DNA, 15 bp, Artificial Sequence
  dgRNA
  S1pr1
gagtccgtcccgcgc

SEQ ID NO: 66669 - DNA, 15 bp, Artificial Sequence
  dgRNA
  S1pr1
agtccgtcccgcgct

SEQ ID NO: 66670 - DNA, 15 bp, Artificial Sequence
  dgRNA
  S1pr1
gtccgtcccgcgctg

SEQ ID NO: 66671 - DNA, 15 bp, Artificial Sequence
  dgRNA
  S1pr1
ccgcgctggggactg

SEQ ID NO: 66672 - DNA, 15 bp, Artificial Sequence
  dgRNA
  Dnaja2
ccaccagccgctctc

SEQ ID NO: 66673 - DNA, 15 bp, Artificial Sequence
  dgRNA
  Dnaja2
caaccccgccccgcc

SEQ ID NO: 66674 - DNA, 15 bp, Artificial Sequence
  dgRNA
  Dnaja2
gcccggccccggagg

SEQ ID NO: 66675 - DNA, 15 bp, Artificial Sequence
  dgRNA
  Dnaja2
cccggccccggaggc

SEQ ID NO: 66676 - DNA, 15 bp, Artificial Sequence
  dgRNA
  Tnfrsf13c
gcggtgacagttgag

SEQ ID NO: 66677 - DNA, 15 bp, Artificial Sequence
  dgRNA
  Tnfrsf13c
tgagtggtttaatgc

SEQ ID NO: 66678 - DNA, 15 bp, Artificial Sequence
  dgRNA
  Tnfrsf13c
gaggatgctgcgtcg

SEQ ID NO: 66679 - DNA, 15 bp, Artificial Sequence
  dgRNA
  Tnfrsf13c
ttcattctagactac

SEQ ID NO: 66680 - DNA, 15 bp, Artificial Sequence
  dgRNA
  Gpld1
ccttgcaacacatct

SEQ ID NO: 66681 - DNA, 15 bp, Artificial Sequence
  dgRNA
  Gpld1
cttgcaacacatctc

SEQ ID NO: 66682 - DNA, 15 bp, Artificial Sequence
  dgRNA
  Gpld1
tcgggtaagtcctgt

SEQ ID NO: 66683 - DNA, 15 bp, Artificial Sequence
  dgRNA
  Gpld1
ccagagtagatggcc

SEQ ID NO: 66684 - DNA, 15 bp, Artificial Sequence
  dgRNA
  Khk
gcagagggatcggaa

SEQ ID NO: 66685 - DNA, 15 bp, Artificial Sequence
  dgRNA
  Khk
tcgctttgacagctg

SEQ ID NO: 66686 - DNA, 15 bp, Artificial Sequence
  dgRNA
  Khk
ggcggaaaagtgaga

SEQ ID NO: 66687 - DNA, 15 bp, Artificial Sequence
  dgRNA
  Khk
gccattggccgggct

SEQ ID NO: 66688 - DNA, 15 bp, Artificial Sequence
  dgRNA
  Mcpt8
gaaattagaggtctc

SEQ ID NO: 66689 - DNA, 15 bp, Artificial Sequence
  dgRNA
  Mcpt8
gaccacattccccac

SEQ ID NO: 66690 - DNA, 15 bp, Artificial Sequence
  dgRNA
  Mcpt8
gtgtggtgactgtac

SEQ ID NO: 66691 - DNA, 15 bp, Artificial Sequence
  dgRNA
  Mcpt8
ttaaaccatcaggtg

SEQ ID NO: 66692 - DNA, 15 bp, Artificial Sequence
  dgRNA
  Zfp277
cccggctccggaagg

SEQ ID NO: 66693 - DNA, 15 bp, Artificial Sequence
  dgRNA
  Zfp277
gaggcgggactacag

SEQ ID NO: 66694 - DNA, 15 bp, Artificial Sequence
  dgRNA
  Zfp277
cgggactacagcggt

SEQ ID NO: 66695 - DNA, 15 bp, Artificial Sequence
  dgRNA
  Zfp277
gggactacagcggtt

SEQ ID NO: 66696 - DNA, 15 bp, Artificial Sequence
  dgRNA
  Dip2c
gcctaactaagcctc

SEQ ID NO: 66697 - DNA, 15 bp, Artificial Sequence
  dgRNA
  Dip2c
gaagaccccctccta

SEQ ID NO: 66698 - DNA, 15 bp, Artificial Sequence
  dgRNA
  Dip2c
tctcgaagtactcgc

SEQ ID NO: 66699 - DNA, 15 bp, Artificial Sequence
  dgRNA
  Dip2c
cgaagtactcgctgg

SEQ ID NO: 66700 - DNA, 15 bp, Artificial Sequence
  dgRNA
  Ssr4
agtgaggacctctac

SEQ ID NO: 66701 - DNA, 15 bp, Artificial Sequence
  dgRNA
  Ssr4
cgttctcgcgacagt

SEQ ID NO: 66702 - DNA, 15 bp, Artificial Sequence
  dgRNA
  Ssr4
gttctcgcgacagtt

SEQ ID NO: 66703 - DNA, 15 bp, Artificial Sequence
  dgRNA
  Ssr4
ttctcgcgacagttg

SEQ ID NO: 66704 - DNA, 15 bp, Artificial Sequence
  dgRNA
  Zfp618
gccgggggcccgcag

SEQ ID NO: 66705 - DNA, 15 bp, Artificial Sequence
  dgRNA
  Zfp618
gggcccgcagcggct

SEQ ID NO: 66706 - DNA, 15 bp, Artificial Sequence
  dgRNA
  Zfp618
cccgcagcggctcgg

SEQ ID NO: 66707 - DNA, 15 bp, Artificial Sequence
  dgRNA
  Zfp618
cagcggctcggaggc

SEQ ID NO: 66708 - DNA, 15 bp, Artificial Sequence
  dgRNA
  Fjx1
ggactagtgggaagt

SEQ ID NO: 66709 - DNA, 15 bp, Artificial Sequence
  dgRNA
  Fjx1
actagtttagtgtaa

SEQ ID NO: 66710 - DNA, 15 bp, Artificial Sequence
  dgRNA
  Rprm
cccctctaagccgag

SEQ ID NO: 66711 - DNA, 15 bp, Artificial Sequence
  dgRNA
  Rprm
cgagcgggcgcagca

SEQ ID NO: 66712 - DNA, 15 bp, Artificial Sequence
  dgRNA
  Rprm
gggccgctgttcgct

SEQ ID NO: 66713 - DNA, 15 bp, Artificial Sequence
  dgRNA
  Rprm
ctgttcgcttggagc

SEQ ID NO: 66714 - DNA, 15 bp, Artificial Sequence
  dgRNA
  4921504E06Rik
cgcaaggcttatgtc

SEQ ID NO: 66715 - DNA, 15 bp, Artificial Sequence
  dgRNA
  4921504E06Rik
aggcttatgtctggt

SEQ ID NO: 66716 - DNA, 15 bp, Artificial Sequence
  dgRNA
  4921504E06Rik
ggtctccggtttctc

SEQ ID NO: 66717 - DNA, 15 bp, Artificial Sequence
  dgRNA
  4921504E06Rik
gtctccggtttctct

SEQ ID NO: 66718 - DNA, 15 bp, Artificial Sequence
  dgRNA
  Foxf2
ggagcgaagctgccg

SEQ ID NO: 66719 - DNA, 15 bp, Artificial Sequence
  dgRNA
  Foxf2
gagcgaagctgccgc

SEQ ID NO: 66720 - DNA, 15 bp, Artificial Sequence
  dgRNA
  Foxf2
agcgaagctgccgcg

SEQ ID NO: 66721 - DNA, 15 bp, Artificial Sequence
  dgRNA
  Foxf2
gaagctgccgcgggg

SEQ ID NO: 66722 - DNA, 15 bp, Artificial Sequence
  dgRNA
  Art4
gcccccgtctctgaa

SEQ ID NO: 66723 - DNA, 15 bp, Artificial Sequence
  dgRNA
  Art4
cccccgtctctgaac

SEQ ID NO: 66724 - DNA, 15 bp, Artificial Sequence
  dgRNA
  Art4
ccccgtctctgaacg

SEQ ID NO: 66725 - DNA, 15 bp, Artificial Sequence
  dgRNA
  Art4
aaacacaccgtggag

SEQ ID NO: 66726 - DNA, 15 bp, Artificial Sequence
  dgRNA
  Nap1l1
agtttcaaaccgcac

SEQ ID NO: 66727 - DNA, 15 bp, Artificial Sequence
  dgRNA
  Nap1l1
gtttcaaaccgcaca

SEQ ID NO: 66728 - DNA, 15 bp, Artificial Sequence
  dgRNA
  Nap1l1
gaaactacatggacc

SEQ ID NO: 66729 - DNA, 15 bp, Artificial Sequence
  dgRNA
  Nap1l1
cggtttgaaactaca

SEQ ID NO: 66730 - DNA, 15 bp, Artificial Sequence
  dgRNA
  Olfr348
gaagcattgcagtta

SEQ ID NO: 66731 - DNA, 15 bp, Artificial Sequence
  dgRNA
  Pld5
caggttggtggcgtg

SEQ ID NO: 66732 - DNA, 15 bp, Artificial Sequence
  dgRNA
  Pld5
agccgtgcggcttcc

SEQ ID NO: 66733 - DNA, 15 bp, Artificial Sequence
  dgRNA
  Csnk2a2
gggtggcctgcagtt

SEQ ID NO: 66734 - DNA, 15 bp, Artificial Sequence
  dgRNA
  Csnk2a2
gccggccacattgct

SEQ ID NO: 66735 - DNA, 15 bp, Artificial Sequence
  dgRNA
  Csnk2a2
gtggcgagctcgctg

SEQ ID NO: 66736 - DNA, 15 bp, Artificial Sequence
  dgRNA
  Csnk2a2
tggcgagctcgctga

SEQ ID NO: 66737 - DNA, 15 bp, Artificial Sequence
  dgRNA
  Dctd
tgaaatcgcactctc

SEQ ID NO: 66738 - DNA, 15 bp, Artificial Sequence
  dgRNA
  Dctd
cgtttgtgctgtgac

SEQ ID NO: 66739 - DNA, 15 bp, Artificial Sequence
  dgRNA
  Dctd
gcacacgttggtaac

SEQ ID NO: 66740 - DNA, 15 bp, Artificial Sequence
  dgRNA
  Dctd
caaacgggcacacgt

SEQ ID NO: 66741 - DNA, 15 bp, Artificial Sequence
  dgRNA
  Rapsn
aaggggacaccaaac

SEQ ID NO: 66742 - DNA, 15 bp, Artificial Sequence
  dgRNA
  Rapsn
aaacaggttctccgg

SEQ ID NO: 66743 - DNA, 15 bp, Artificial Sequence
  dgRNA
  Rapsn
cagtgcctatatccc

SEQ ID NO: 66744 - DNA, 15 bp, Artificial Sequence
  dgRNA
  Rapsn
agtgcctatatccct

SEQ ID NO: 66745 - DNA, 15 bp, Artificial Sequence
  dgRNA
  Nup62cl
ggggaatcccatgct

SEQ ID NO: 66746 - DNA, 15 bp, Artificial Sequence
  dgRNA
  Nup62cl
ctaagtaggtcgact

SEQ ID NO: 66747 - DNA, 15 bp, Artificial Sequence
  dgRNA
  Nup62cl
taagtaggtcgactc

SEQ ID NO: 66748 - DNA, 15 bp, Artificial Sequence
  dgRNA
  Nup62cl
aggtcgactcgggtt

SEQ ID NO: 66749 - DNA, 15 bp, Artificial Sequence
  dgRNA
  Magix
acagctcccgcaacc

SEQ ID NO: 66750 - DNA, 15 bp, Artificial Sequence
  dgRNA
  Magix
tgcctgcggccaggt

SEQ ID NO: 66751 - DNA, 15 bp, Artificial Sequence
  dgRNA
  Magix
ggtcacctcctggtc

SEQ ID NO: 66752 - DNA, 15 bp, Artificial Sequence
  dgRNA
  Magix
cctggtccgggcgcc

SEQ ID NO: 66753 - DNA, 15 bp, Artificial Sequence
  dgRNA
  Synpo
gaagggggacccttc

SEQ ID NO: 66754 - DNA, 15 bp, Artificial Sequence
  dgRNA
  Synpo
ggctcttccacggtt

SEQ ID NO: 66755 - DNA, 15 bp, Artificial Sequence
  dgRNA
  Synpo
gaggaccggtgaatc

SEQ ID NO: 66756 - DNA, 15 bp, Artificial Sequence
  dgRNA
  Synpo
gtgaatctggctgcg

SEQ ID NO: 66757 - DNA, 15 bp, Artificial Sequence
  dgRNA
  4931431F19Rik
gccccgcccccaatt

SEQ ID NO: 66758 - DNA, 15 bp, Artificial Sequence
  dgRNA
  4931431F19Rik
ttaagcaccaaattg

SEQ ID NO: 66759 - DNA, 15 bp, Artificial Sequence
  dgRNA
  4931431F19Rik
gtttaagcaccaaat

SEQ ID NO: 66760 - DNA, 15 bp, Artificial Sequence
  dgRNA
  4931431F19Rik
aggtacatctgaatg

SEQ ID NO: 66761 - DNA, 15 bp, Artificial Sequence
  dgRNA
  Lca5
gggttggcattcttt

SEQ ID NO: 66762 - DNA, 15 bp, Artificial Sequence
  dgRNA
  Lca5
ctttcggtctgtcct

SEQ ID NO: 66763 - DNA, 15 bp, Artificial Sequence
  dgRNA
  Lca5
gtgcaactgtcctcg

SEQ ID NO: 66764 - DNA, 15 bp, Artificial Sequence
  dgRNA
  Lca5
tgcaactgtcctcgc

SEQ ID NO: 66765 - DNA, 15 bp, Artificial Sequence
  dgRNA
  Supt7l
gatgtgaatagcact

SEQ ID NO: 66766 - DNA, 15 bp, Artificial Sequence
  dgRNA
  Supt7l
atgtgaatagcacta

SEQ ID NO: 66767 - DNA, 15 bp, Artificial Sequence
  dgRNA
  Supt7l
caataccagaaagcg

SEQ ID NO: 66768 - DNA, 15 bp, Artificial Sequence
  dgRNA
  Supt7l
ggatacggacatttt

SEQ ID NO: 66769 - DNA, 15 bp, Artificial Sequence
  dgRNA
  Gpr22
ttaagccaatacaac

SEQ ID NO: 66770 - DNA, 15 bp, Artificial Sequence
  dgRNA
  Gpr22
cttcatatgtatggc

SEQ ID NO: 66771 - DNA, 15 bp, Artificial Sequence
  dgRNA
  Gpr22
attggccagttgtat

SEQ ID NO: 66772 - DNA, 15 bp, Artificial Sequence
  dgRNA
  Olfr304
acctatgtagtttcc

SEQ ID NO: 66773 - DNA, 15 bp, Artificial Sequence
  dgRNA
  Olfr304
cacctgacagaccat

SEQ ID NO: 66774 - DNA, 15 bp, Artificial Sequence
  dgRNA
  Olfr304
gcataaatgctctct

SEQ ID NO: 66775 - DNA, 15 bp, Artificial Sequence
  dgRNA
  Olfr304
tctcgttttttccca

SEQ ID NO: 66776 - DNA, 15 bp, Artificial Sequence
  dgRNA
  Pet2
tcacagtagccgatg

SEQ ID NO: 66777 - DNA, 15 bp, Artificial Sequence
  dgRNA
  Dpp10
gtctgcattttcggg

SEQ ID NO: 66778 - DNA, 15 bp, Artificial Sequence
  dgRNA
  Dpp10
tgcattttcgggtgg

SEQ ID NO: 66779 - DNA, 15 bp, Artificial Sequence
  dgRNA
  Dpp10
acagtggggagtccg

SEQ ID NO: 66780 - DNA, 15 bp, Artificial Sequence
  dgRNA
  Dpp10
gaggatctgcggtag

SEQ ID NO: 66781 - DNA, 15 bp, Artificial Sequence
  dgRNA
  Hipk2
tcgcatccgtgccat

SEQ ID NO: 66782 - DNA, 15 bp, Artificial Sequence
  dgRNA
  Hipk2
gcgctcgattgcgcg

SEQ ID NO: 66783 - DNA, 15 bp, Artificial Sequence
  dgRNA
  Hipk2
tgcgcgcggactccc

SEQ ID NO: 66784 - DNA, 15 bp, Artificial Sequence
  dgRNA
  Hipk2
gcgcgcggactccct

SEQ ID NO: 66785 - DNA, 15 bp, Artificial Sequence
  dgRNA
  Atxn7l3b
gccagttgtcgccac

SEQ ID NO: 66786 - DNA, 15 bp, Artificial Sequence
  dgRNA
  Atxn7l3b
agcccagcctccgcg

SEQ ID NO: 66787 - DNA, 15 bp, Artificial Sequence
  dgRNA
  Atxn7l3b
gcggagccagtgcgc

SEQ ID NO: 66788 - DNA, 15 bp, Artificial Sequence
  dgRNA
  Atxn7l3b
gcgcaggcgcagcac

SEQ ID NO: 66789 - DNA, 15 bp, Artificial Sequence
  dgRNA
  Dab2ip
ggcgggggcaagcgc

SEQ ID NO: 66790 - DNA, 15 bp, Artificial Sequence
  dgRNA
  Dab2ip
aagcgctggcagccg

SEQ ID NO: 66791 - DNA, 15 bp, Artificial Sequence
  dgRNA
  Dab2ip
agcgctggcagccga

SEQ ID NO: 66792 - DNA, 15 bp, Artificial Sequence
  dgRNA
  Dab2ip
gcgctggcagccgag

SEQ ID NO: 66793 - DNA, 15 bp, Artificial Sequence
  dgRNA
  Fgg
ctggaggtggtgtac

SEQ ID NO: 66794 - DNA, 15 bp, Artificial Sequence
  dgRNA
  Fgg
agtagttgcaacacg

SEQ ID NO: 66795 - DNA, 15 bp, Artificial Sequence
  dgRNA
  Fgg
ccccccctgttttgc

SEQ ID NO: 66796 - DNA, 15 bp, Artificial Sequence
  dgRNA
  Fgg
cctgtgcgcaaaatc

SEQ ID NO: 66797 - DNA, 15 bp, Artificial Sequence
  dgRNA
  Pmp22
ggttttgcagagatc

SEQ ID NO: 66798 - DNA, 15 bp, Artificial Sequence
  dgRNA
  Pmp22
gatctggtttttccg

SEQ ID NO: 66799 - DNA, 15 bp, Artificial Sequence
  dgRNA
  Pmp22
atctggtttttccgg

SEQ ID NO: 66800 - DNA, 15 bp, Artificial Sequence
  dgRNA
  Pmp22
gtccaagtaactgtc

SEQ ID NO: 66801 - DNA, 15 bp, Artificial Sequence
  dgRNA
  Gas2
agcttggccccaact

SEQ ID NO: 66802 - DNA, 15 bp, Artificial Sequence
  dgRNA
  Gas2
cgttttacttcctct

SEQ ID NO: 66803 - DNA, 15 bp, Artificial Sequence
  dgRNA
  Gas2
tcctcttggtccgtg

SEQ ID NO: 66804 - DNA, 15 bp, Artificial Sequence
  dgRNA
  Gas2
ggactgatgaaatgt

SEQ ID NO: 66805 - DNA, 15 bp, Artificial Sequence
  dgRNA
  Adarb2
agttcggtgtgattg

SEQ ID NO: 66806 - DNA, 15 bp, Artificial Sequence
  dgRNA
  Adarb2
cgaactggttttact

SEQ ID NO: 66807 - DNA, 15 bp, Artificial Sequence
  dgRNA
  Adarb2
ccgaactggttttac

SEQ ID NO: 66808 - DNA, 15 bp, Artificial Sequence
  dgRNA
  Adarb2
acaatcacaccgaac

SEQ ID NO: 66809 - DNA, 15 bp, Artificial Sequence
  dgRNA
  Ssb
taacaatttctcggg

SEQ ID NO: 66810 - DNA, 15 bp, Artificial Sequence
  dgRNA
  Ssb
aacaatttctcgggc

SEQ ID NO: 66811 - DNA, 15 bp, Artificial Sequence
  dgRNA
  Ssb
aatttctcgggcggg

SEQ ID NO: 66812 - DNA, 15 bp, Artificial Sequence
  dgRNA
  Ssb
atttctcgggcggga

SEQ ID NO: 66813 - DNA, 15 bp, Artificial Sequence
  dgRNA
  Tomt
tacctatctctacaa

SEQ ID NO: 66814 - DNA, 15 bp, Artificial Sequence
  dgRNA
  Tomt
acctatctctacaat

SEQ ID NO: 66815 - DNA, 15 bp, Artificial Sequence
  dgRNA
  Tomt
gacatcgggacgttg

SEQ ID NO: 66816 - DNA, 15 bp, Artificial Sequence
  dgRNA
  Tomt
agacatcgggacgtt

SEQ ID NO: 66817 - DNA, 15 bp, Artificial Sequence
  dgRNA
  Klra1
atcagcgtattcttg

SEQ ID NO: 66818 - DNA, 15 bp, Artificial Sequence
  dgRNA
  Klra1
tcagcgtattcttgt

SEQ ID NO: 66819 - DNA, 15 bp, Artificial Sequence
  dgRNA
  Klra1
cgtattcttgtggga

SEQ ID NO: 66820 - DNA, 15 bp, Artificial Sequence
  dgRNA
  Pfn2
gttccttgtactcaa

SEQ ID NO: 66821 - DNA, 15 bp, Artificial Sequence
  dgRNA
  Pfn2
ccttgtactcaaagg

SEQ ID NO: 66822 - DNA, 15 bp, Artificial Sequence
  dgRNA
  Pfn2
atttcaggagcgtgc

SEQ ID NO: 66823 - DNA, 15 bp, Artificial Sequence
  dgRNA
  Pfn2
gcgtgcaggcgcagc

SEQ ID NO: 66824 - DNA, 15 bp, Artificial Sequence
  dgRNA
  Gm4461
cactaattaggatca

SEQ ID NO: 66825 - DNA, 15 bp, Artificial Sequence
  dgRNA
  Ugcg
gcggttggtagctgc

SEQ ID NO: 66826 - DNA, 15 bp, Artificial Sequence
  dgRNA
  Ugcg
cggttggtagctgcc

SEQ ID NO: 66827 - DNA, 15 bp, Artificial Sequence
  dgRNA
  Ugcg
ttggtagctgccggg

SEQ ID NO: 66828 - DNA, 15 bp, Artificial Sequence
  dgRNA
  Ugcg
cgggcggcgagcacg

SEQ ID NO: 66829 - DNA, 15 bp, Artificial Sequence
  dgRNA
  Adcy2
tgtgcagcctgcgac

SEQ ID NO: 66830 - DNA, 15 bp, Artificial Sequence
  dgRNA
  Adcy2
cagcctgcgacaggc

SEQ ID NO: 66831 - DNA, 15 bp, Artificial Sequence
  dgRNA
  Adcy2
ctgcgacaggctgga

SEQ ID NO: 66832 - DNA, 15 bp, Artificial Sequence
  dgRNA
  Adcy2
gcccagcctggccgt

SEQ ID NO: 66833 - DNA, 15 bp, Artificial Sequence
  dgRNA
  Olfr1302
cattagctttcacgt

SEQ ID NO: 66834 - DNA, 15 bp, Artificial Sequence
  dgRNA
  Olfr1302
attagctttcacgtt

SEQ ID NO: 66835 - DNA, 15 bp, Artificial Sequence
  dgRNA
  Olfr1302
tctcaaagtttgcgc

SEQ ID NO: 66836 - DNA, 15 bp, Artificial Sequence
  dgRNA
  Olfr1302
gagcaattctccaaa

SEQ ID NO: 66837 - DNA, 15 bp, Artificial Sequence
  dgRNA
  Ppa1
agcgttctgtcccag

SEQ ID NO: 66838 - DNA, 15 bp, Artificial Sequence
  dgRNA
  Ppa1
gcagtccgcttccag

SEQ ID NO: 66839 - DNA, 15 bp, Artificial Sequence
  dgRNA
  Ppa1
cagtccgcttccaga

SEQ ID NO: 66840 - DNA, 15 bp, Artificial Sequence
  dgRNA
  Ppa1
ccggcgcctgccacg

SEQ ID NO: 66841 - DNA, 15 bp, Artificial Sequence
  dgRNA
  Ddx43
tgaacctgaatttcg

SEQ ID NO: 66842 - DNA, 15 bp, Artificial Sequence
  dgRNA
  Ddx43
ctgaatttcgaggca

SEQ ID NO: 66843 - DNA, 15 bp, Artificial Sequence
  dgRNA
  Ddx43
atttcgaggcacggt

SEQ ID NO: 66844 - DNA, 15 bp, Artificial Sequence
  dgRNA
  Ddx43
tttcgaggcacggtt

SEQ ID NO: 66845 - DNA, 15 bp, Artificial Sequence
  dgRNA
  Nono
ttcagtccttccgta

SEQ ID NO: 66846 - DNA, 15 bp, Artificial Sequence
  dgRNA
  Nono
gtccttccgtagggc

SEQ ID NO: 66847 - DNA, 15 bp, Artificial Sequence
  dgRNA
  Nono
tccttccgtagggcc

SEQ ID NO: 66848 - DNA, 15 bp, Artificial Sequence
  dgRNA
  Nono
tttccgtcttgtgct

SEQ ID NO: 66849 - DNA, 15 bp, Artificial Sequence
  dgRNA
  Asb8
ttggaccaggacacg

SEQ ID NO: 66850 - DNA, 15 bp, Artificial Sequence
  dgRNA
  Asb8
cctataagcagcgac

SEQ ID NO: 66851 - DNA, 15 bp, Artificial Sequence
  dgRNA
  Asb8
ctataagcagcgaca

SEQ ID NO: 66852 - DNA, 15 bp, Artificial Sequence
  dgRNA
  Asb8
tataagcagcgacag

SEQ ID NO: 66853 - DNA, 15 bp, Artificial Sequence
  dgRNA
  Olfr954
tacaagtgttataca

SEQ ID NO: 66854 - DNA, 15 bp, Artificial Sequence
  dgRNA
  Olfr954
agtataacagactta

SEQ ID NO: 66855 - DNA, 15 bp, Artificial Sequence
  dgRNA
  Pttg1ip
gttccagcagcgcgc

SEQ ID NO: 66856 - DNA, 15 bp, Artificial Sequence
  dgRNA
  Pttg1ip
ctcagctgcgcccgt

SEQ ID NO: 66857 - DNA, 15 bp, Artificial Sequence
  dgRNA
  Pttg1ip
agctgcgcccgtagg

SEQ ID NO: 66858 - DNA, 15 bp, Artificial Sequence
  dgRNA
  Pttg1ip
gctgcgcccgtaggc

SEQ ID NO: 66859 - DNA, 15 bp, Artificial Sequence
  dgRNA
  Kctd9
cagccggactctgat

SEQ ID NO: 66860 - DNA, 15 bp, Artificial Sequence
  dgRNA
  Kctd9
tgattggctaaatac

SEQ ID NO: 66861 - DNA, 15 bp, Artificial Sequence
  dgRNA
  Kctd9
tggctaaatactggc

SEQ ID NO: 66862 - DNA, 15 bp, Artificial Sequence
  dgRNA
  Kctd9
gtacagcgtgttgat

SEQ ID NO: 66863 - DNA, 15 bp, Artificial Sequence
  dgRNA
  Ifitm1
tttttaagtacgtta

SEQ ID NO: 66864 - DNA, 15 bp, Artificial Sequence
  dgRNA
  Ifitm1
ttttaagtacgttaa

SEQ ID NO: 66865 - DNA, 15 bp, Artificial Sequence
  dgRNA
  Ifitm1
tttaagtacgttaag

SEQ ID NO: 66866 - DNA, 15 bp, Artificial Sequence
  dgRNA
  Ifitm1
ttaagtacgttaagg

SEQ ID NO: 66867 - DNA, 15 bp, Artificial Sequence
  dgRNA
  Arl2bp
ctctggcctcaatcg

SEQ ID NO: 66868 - DNA, 15 bp, Artificial Sequence
  dgRNA
  Arl2bp
gaccagttaccccct

SEQ ID NO: 66869 - DNA, 15 bp, Artificial Sequence
  dgRNA
  Arl2bp
agttaccccctaggc

SEQ ID NO: 66870 - DNA, 15 bp, Artificial Sequence
  dgRNA
  Arl2bp
tgccactcccgcgtg

SEQ ID NO: 66871 - DNA, 15 bp, Artificial Sequence
  dgRNA
  Olfr1303
tatctatagtccagt

SEQ ID NO: 66872 - DNA, 15 bp, Artificial Sequence
  dgRNA
  Rbm26
cctggtgaagtaaga

SEQ ID NO: 66873 - DNA, 15 bp, Artificial Sequence
  dgRNA
  Rbm26
gcttattcaccacga

SEQ ID NO: 66874 - DNA, 15 bp, Artificial Sequence
  dgRNA
  Rbm26
caccacgaaggccga

SEQ ID NO: 66875 - DNA, 15 bp, Artificial Sequence
  dgRNA
  Rbm26
aggccgatggataaa

SEQ ID NO: 66876 - DNA, 15 bp, Artificial Sequence
  dgRNA
  Amer2
cagcgagagccgctc

SEQ ID NO: 66877 - DNA, 15 bp, Artificial Sequence
  dgRNA
  Amer2
ggttgatttagaacg

SEQ ID NO: 66878 - DNA, 15 bp, Artificial Sequence
  dgRNA
  Amer2
gttgatttagaacgc

SEQ ID NO: 66879 - DNA, 15 bp, Artificial Sequence
  dgRNA
  Amer2
gaacgcgggtgacag

SEQ ID NO: 66880 - DNA, 15 bp, Artificial Sequence
  dgRNA
  Znrf1
tgcatgcagtagatt

SEQ ID NO: 66881 - DNA, 15 bp, Artificial Sequence
  dgRNA
  Znrf1
gtattgccccacagc

SEQ ID NO: 66882 - DNA, 15 bp, Artificial Sequence
  dgRNA
  Znrf1
gctggcacatgacta

SEQ ID NO: 66883 - DNA, 15 bp, Artificial Sequence
  dgRNA
  Znrf1
cttatcgtggagcag

SEQ ID NO: 66884 - DNA, 15 bp, Artificial Sequence
  dgRNA
  Med1
cccctctgagtggcg

SEQ ID NO: 66885 - DNA, 15 bp, Artificial Sequence
  dgRNA
  Med1
cggggaaaggctccc

SEQ ID NO: 66886 - DNA, 15 bp, Artificial Sequence
  dgRNA
  Med1
aggctccccggctcg

SEQ ID NO: 66887 - DNA, 15 bp, Artificial Sequence
  dgRNA
  Med1
gacctccccgctgtc

SEQ ID NO: 66888 - DNA, 15 bp, Artificial Sequence
  dgRNA
  Olfr483
ccaaacatctattgt

SEQ ID NO: 66889 - DNA, 15 bp, Artificial Sequence
  dgRNA
  Olfr483
ccaacaatagatgtt

SEQ ID NO: 66890 - DNA, 15 bp, Artificial Sequence
  dgRNA
  Caskin1
tcggagccaggcgcg

SEQ ID NO: 66891 - DNA, 15 bp, Artificial Sequence
  dgRNA
  Caskin1
agccaggcgcgcggc

SEQ ID NO: 66892 - DNA, 15 bp, Artificial Sequence
  dgRNA
  Caskin1
gccggcgcgggctga

SEQ ID NO: 66893 - DNA, 15 bp, Artificial Sequence
  dgRNA
  Caskin1
ggcgcgggctgacgg

SEQ ID NO: 66894 - DNA, 15 bp, Artificial Sequence
  dgRNA
  Bcl2l1
cttggaagtcccttt

SEQ ID NO: 66895 - DNA, 15 bp, Artificial Sequence
  dgRNA
  Bcl2l1
ttggaagtcccttta

SEQ ID NO: 66896 - DNA, 15 bp, Artificial Sequence
  dgRNA
  Bcl2l1
gtccctttagggttt

SEQ ID NO: 66897 - DNA, 15 bp, Artificial Sequence
  dgRNA
  Bcl2l1
tcggaagcctcatct

SEQ ID NO: 66898 - DNA, 15 bp, Artificial Sequence
  dgRNA
  Rbak
gtaagttcttgcgcg

SEQ ID NO: 66899 - DNA, 15 bp, Artificial Sequence
  dgRNA
  Rbak
gatccctagatgcag

SEQ ID NO: 66900 - DNA, 15 bp, Artificial Sequence
  dgRNA
  Rbak
tgcagtggcgcgcga

SEQ ID NO: 66901 - DNA, 15 bp, Artificial Sequence
  dgRNA
  Rbak
gcgcgcgaaggcgtc

SEQ ID NO: 66902 - DNA, 15 bp, Artificial Sequence
  dgRNA
  Mboat4
tcagtaaacactgcg

SEQ ID NO: 66903 - DNA, 15 bp, Artificial Sequence
  dgRNA
  Mboat4
cagtaaacactgcga

SEQ ID NO: 66904 - DNA, 15 bp, Artificial Sequence
  dgRNA
  Mboat4
agtaaacactgcgag

SEQ ID NO: 66905 - DNA, 15 bp, Artificial Sequence
  dgRNA
  Mboat4
aatgcctgcatactt

SEQ ID NO: 66906 - DNA, 15 bp, Artificial Sequence
  dgRNA
  Tmem170b
gtgacccgggcctcg

SEQ ID NO: 66907 - DNA, 15 bp, Artificial Sequence
  dgRNA
  Tmem170b
ccgggcctcgtggcg

SEQ ID NO: 66908 - DNA, 15 bp, Artificial Sequence
  dgRNA
  Tmem170b
ggcctcgtggcgtgg

SEQ ID NO: 66909 - DNA, 15 bp, Artificial Sequence
  dgRNA
  Tmem170b
gcctcgtggcgtggc

SEQ ID NO: 66910 - DNA, 15 bp, Artificial Sequence
  dgRNA
  Mfsd4
cgcccggcctccggt

SEQ ID NO: 66911 - DNA, 15 bp, Artificial Sequence
  dgRNA
  Mfsd4
gcctccggttggccg

SEQ ID NO: 66912 - DNA, 15 bp, Artificial Sequence
  dgRNA
  Mfsd4
gttggccgcggcact

SEQ ID NO: 66913 - DNA, 15 bp, Artificial Sequence
  dgRNA
  Mfsd4
cgcggcactcggccc

SEQ ID NO: 66914 - DNA, 15 bp, Artificial Sequence
  dgRNA
  Pick1
ccaagggcggggtcc

SEQ ID NO: 66915 - DNA, 15 bp, Artificial Sequence
  dgRNA
  Pick1
caagggcggggtccg

SEQ ID NO: 66916 - DNA, 15 bp, Artificial Sequence
  dgRNA
  Pick1
cagagagtcccggag

SEQ ID NO: 66917 - DNA, 15 bp, Artificial Sequence
  dgRNA
  Pick1
agaagggttgcctgc

SEQ ID NO: 66918 - DNA, 15 bp, Artificial Sequence
  dgRNA
  Neu3
acaattagactgtct

SEQ ID NO: 66919 - DNA, 15 bp, Artificial Sequence
  dgRNA
  Neu3
caattagactgtcta

SEQ ID NO: 66920 - DNA, 15 bp, Artificial Sequence
  dgRNA
  Neu3
acagaccaatcgtta

SEQ ID NO: 66921 - DNA, 15 bp, Artificial Sequence
  dgRNA
  Neu3
cagaccaatcgttaa

SEQ ID NO: 66922 - DNA, 15 bp, Artificial Sequence
  dgRNA
  Ap1s1
gccccgcctgcgcgc

SEQ ID NO: 66923 - DNA, 15 bp, Artificial Sequence
  dgRNA
  Ap1s1
gcgcgccggatgaga

SEQ ID NO: 66924 - DNA, 15 bp, Artificial Sequence
  dgRNA
  Ap1s1
cgcgccggatgagat

SEQ ID NO: 66925 - DNA, 15 bp, Artificial Sequence
  dgRNA
  Ap1s1
gcgccggatgagatg

SEQ ID NO: 66926 - DNA, 15 bp, Artificial Sequence
  dgRNA
  Olfr1279
gctagccaactcaga

SEQ ID NO: 66927 - DNA, 15 bp, Artificial Sequence
  dgRNA
  Olfr1279
aattcacttgatgtg

SEQ ID NO: 66928 - DNA, 15 bp, Artificial Sequence
  dgRNA
  Aif1
aaatcttggcagtac

SEQ ID NO: 66929 - DNA, 15 bp, Artificial Sequence
  dgRNA
  Aif1
ggtagccgtggtgat

SEQ ID NO: 66930 - DNA, 15 bp, Artificial Sequence
  dgRNA
  Aif1
aaggcccaaactaac

SEQ ID NO: 66931 - DNA, 15 bp, Artificial Sequence
  dgRNA
  Aif1
gtgtcagtagcccac

SEQ ID NO: 66932 - DNA, 15 bp, Artificial Sequence
  dgRNA
  Myo9a
atcgagaatctaaca

SEQ ID NO: 66933 - DNA, 15 bp, Artificial Sequence
  dgRNA
  Myo9a
gagaatctaacacgg

SEQ ID NO: 66934 - DNA, 15 bp, Artificial Sequence
  dgRNA
  Myo9a
gccgtaaagtgaaga

SEQ ID NO: 66935 - DNA, 15 bp, Artificial Sequence
  dgRNA
  Myo9a
ggcggggccattcgg

SEQ ID NO: 66936 - DNA, 15 bp, Artificial Sequence
  dgRNA
  E030030I06Rik
ctctgcgaccccaca

SEQ ID NO: 66937 - DNA, 15 bp, Artificial Sequence
  dgRNA
  E030030I06Rik
tctgcgaccccacat

SEQ ID NO: 66938 - DNA, 15 bp, Artificial Sequence
  dgRNA
  E030030I06Rik
gttccgaactccccc

SEQ ID NO: 66939 - DNA, 15 bp, Artificial Sequence
  dgRNA
  E030030I06Rik
tccgcgcgacgagtc

SEQ ID NO: 66940 - DNA, 15 bp, Artificial Sequence
  dgRNA
  Olfr578
ggacatggtgccata

SEQ ID NO: 66941 - DNA, 15 bp, Artificial Sequence
  dgRNA
  Olfr578
tatcactcacttaca

SEQ ID NO: 66942 - DNA, 15 bp, Artificial Sequence
  dgRNA
  Olfr578
ggtgaattatcatga

SEQ ID NO: 66943 - DNA, 15 bp, Artificial Sequence
  dgRNA
  Olfr578
ataaacaccaaccta

SEQ ID NO: 66944 - DNA, 15 bp, Artificial Sequence
  dgRNA
  Nod2
ccttgtgattgaaac

SEQ ID NO: 66945 - DNA, 15 bp, Artificial Sequence
  dgRNA
  Nod2
tgaaaccggtcccca

SEQ ID NO: 66946 - DNA, 15 bp, Artificial Sequence
  dgRNA
  Nod2
gaaaccggtccccaa

SEQ ID NO: 66947 - DNA, 15 bp, Artificial Sequence
  dgRNA
  Nod2
ccctagagggaaatc

SEQ ID NO: 66948 - DNA, 15 bp, Artificial Sequence
  dgRNA
  Oas1g
gcattcttccttcga

SEQ ID NO: 66949 - DNA, 15 bp, Artificial Sequence
  dgRNA
  Oas1g
cattcttccttcgat

SEQ ID NO: 66950 - DNA, 15 bp, Artificial Sequence
  dgRNA
  Oas1g
aggcttggcggtacc

SEQ ID NO: 66951 - DNA, 15 bp, Artificial Sequence
  dgRNA
  Oas1g
agccattggctgtcg

SEQ ID NO: 66952 - DNA, 15 bp, Artificial Sequence
  dgRNA
  Slc35e4
gatttaggtctcagg

SEQ ID NO: 66953 - DNA, 15 bp, Artificial Sequence
  dgRNA
  Slc35e4
atttaggtctcaggt

SEQ ID NO: 66954 - DNA, 15 bp, Artificial Sequence
  dgRNA
  Slc35e4
acgcttgcaacagtg

SEQ ID NO: 66955 - DNA, 15 bp, Artificial Sequence
  dgRNA
  Slc35e4
agtcacgaccaccag

SEQ ID NO: 66956 - DNA, 15 bp, Artificial Sequence
  dgRNA
  Ado
cgctcccgccgcgcc

SEQ ID NO: 66957 - DNA, 15 bp, Artificial Sequence
  dgRNA
  Ado
cccggctgtagtcgt

SEQ ID NO: 66958 - DNA, 15 bp, Artificial Sequence
  dgRNA
  Ado
ctgtagtcgttggtg

SEQ ID NO: 66959 - DNA, 15 bp, Artificial Sequence
  dgRNA
  Ado
tgtagtcgttggtgt

SEQ ID NO: 66960 - DNA, 15 bp, Artificial Sequence
  dgRNA
  Olfr923
taatcacacactgca

SEQ ID NO: 66961 - DNA, 15 bp, Artificial Sequence
  dgRNA
  Olfr923
tctgcaaaccatata

SEQ ID NO: 66962 - DNA, 15 bp, Artificial Sequence
  dgRNA
  Olfr923
tattagtggctttgc

SEQ ID NO: 66963 - DNA, 15 bp, Artificial Sequence
  dgRNA
  Olfr923
taaaagatccttata

SEQ ID NO: 66964 - DNA, 15 bp, Artificial Sequence
  dgRNA
  Mpdu1
cgcggcgcgcatgcg

SEQ ID NO: 66965 - DNA, 15 bp, Artificial Sequence
  dgRNA
  Mpdu1
cgcggcgcggataaa

SEQ ID NO: 66966 - DNA, 15 bp, Artificial Sequence
  dgRNA
  Mpdu1
ggcgcggataaatgg

SEQ ID NO: 66967 - DNA, 15 bp, Artificial Sequence
  dgRNA
  Mpdu1
gcgcggataaatggc

SEQ ID NO: 66968 - DNA, 15 bp, Artificial Sequence
  dgRNA
  A630033H20Rik
gggcgtgtgcatagc

SEQ ID NO: 66969 - DNA, 15 bp, Artificial Sequence
  dgRNA
  A630033H20Rik
caggctggctatatg

SEQ ID NO: 66970 - DNA, 15 bp, Artificial Sequence
  dgRNA
  Tfpi
gtattgttgtctatt

SEQ ID NO: 66971 - DNA, 15 bp, Artificial Sequence
  dgRNA
  Tfpi
tggtaggcaccagat

SEQ ID NO: 66972 - DNA, 15 bp, Artificial Sequence
  dgRNA
  Tfpi
ggtaggcaccagata

SEQ ID NO: 66973 - DNA, 15 bp, Artificial Sequence
  dgRNA
  Tfpi
atagggagagggccg

SEQ ID NO: 66974 - DNA, 15 bp, Artificial Sequence
  dgRNA
  Nsfl1c
gcggagcctacgagc

SEQ ID NO: 66975 - DNA, 15 bp, Artificial Sequence
  dgRNA
  Nsfl1c
cgagcaggcgcccag

SEQ ID NO: 66976 - DNA, 15 bp, Artificial Sequence
  dgRNA
  Nsfl1c
caggcgcccagcggc

SEQ ID NO: 66977 - DNA, 15 bp, Artificial Sequence
  dgRNA
  Nsfl1c
cccagcggctggacg

SEQ ID NO: 66978 - DNA, 15 bp, Artificial Sequence
  dgRNA
  Pld1
tgtctacttagcata

SEQ ID NO: 66979 - DNA, 15 bp, Artificial Sequence
  dgRNA
  Pld1
gtctacttagcatat

SEQ ID NO: 66980 - DNA, 15 bp, Artificial Sequence
  dgRNA
  Pld1
tctacttagcatatg

SEQ ID NO: 66981 - DNA, 15 bp, Artificial Sequence
  dgRNA
  Pld1
ttagcatatggggcg

SEQ ID NO: 66982 - DNA, 15 bp, Artificial Sequence
  dgRNA
  Lhx9
ctgaataaaaatccg

SEQ ID NO: 66983 - DNA, 15 bp, Artificial Sequence
  dgRNA
  Lhx9
atccgtggcagctcc

SEQ ID NO: 66984 - DNA, 15 bp, Artificial Sequence
  dgRNA
  Lhx9
agtctcttaacaaat

SEQ ID NO: 66985 - DNA, 15 bp, Artificial Sequence
  dgRNA
  Lhx9
ggacacagctccggc

SEQ ID NO: 66986 - DNA, 15 bp, Artificial Sequence
  dgRNA
  Bmp1
cagcggattcccctc

SEQ ID NO: 66987 - DNA, 15 bp, Artificial Sequence
  dgRNA
  Bmp1
agcggattcccctcc

SEQ ID NO: 66988 - DNA, 15 bp, Artificial Sequence
  dgRNA
  Bmp1
gcggattcccctccg

SEQ ID NO: 66989 - DNA, 15 bp, Artificial Sequence
  dgRNA
  Bmp1
gattcccctccgggg

SEQ ID NO: 66990 - DNA, 15 bp, Artificial Sequence
  dgRNA
  Nme5
gagccatttaaaacg

SEQ ID NO: 66991 - DNA, 15 bp, Artificial Sequence
  dgRNA
  Nme5
catttaaaacgcggc

SEQ ID NO: 66992 - DNA, 15 bp, Artificial Sequence
  dgRNA
  Nme5
aaacgcggctggaat

SEQ ID NO: 66993 - DNA, 15 bp, Artificial Sequence
  dgRNA
  Nme5
tctgcagccaccgtt

SEQ ID NO: 66994 - DNA, 15 bp, Artificial Sequence
  dgRNA
  Wdr91
gcaagccgagacgcc

SEQ ID NO: 66995 - DNA, 15 bp, Artificial Sequence
  dgRNA
  Wdr91
caagccgagacgccc

SEQ ID NO: 66996 - DNA, 15 bp, Artificial Sequence
  dgRNA
  Wdr91
gagacgcccgggagc

SEQ ID NO: 66997 - DNA, 15 bp, Artificial Sequence
  dgRNA
  Wdr91
tgggcggggcgcctg

SEQ ID NO: 66998 - DNA, 15 bp, Artificial Sequence
  dgRNA
  Otulin
cccggacatgcgcag

SEQ ID NO: 66999 - DNA, 15 bp, Artificial Sequence
  dgRNA
  Otulin
ccggacatgcgcagt

SEQ ID NO: 67000 - DNA, 15 bp, Artificial Sequence
  dgRNA
  Otulin
agtgggcacacggcg

SEQ ID NO: 67001 - DNA, 15 bp, Artificial Sequence
  dgRNA
  Otulin
gtgggcacacggcgc

SEQ ID NO: 67002 - DNA, 15 bp, Artificial Sequence
  dgRNA
  Gnpat
gcgtttcactgtctt

SEQ ID NO: 67003 - DNA, 15 bp, Artificial Sequence
  dgRNA
  Gnpat
gagctacgctcaccc

SEQ ID NO: 67004 - DNA, 15 bp, Artificial Sequence
  dgRNA
  Gnpat
cacccaggtcgtaga

SEQ ID NO: 67005 - DNA, 15 bp, Artificial Sequence
  dgRNA
  Gnpat
agagggtccgcagaa

SEQ ID NO: 67006 - DNA, 15 bp, Artificial Sequence
  dgRNA
  Omg
atgcaaattagggct

SEQ ID NO: 67007 - DNA, 15 bp, Artificial Sequence
  dgRNA
  Omg
catgcaaattagggc

SEQ ID NO: 67008 - DNA, 15 bp, Artificial Sequence
  dgRNA
  Omg
gcatacgcaacaaaa

SEQ ID NO: 67009 - DNA, 15 bp, Artificial Sequence
  dgRNA
  Mis18bp1
ctccacgagcaaccg

SEQ ID NO: 67010 - DNA, 15 bp, Artificial Sequence
  dgRNA
  Mis18bp1
tccacgagcaaccga

SEQ ID NO: 67011 - DNA, 15 bp, Artificial Sequence
  dgRNA
  Mis18bp1
ccacgagcaaccgag

SEQ ID NO: 67012 - DNA, 15 bp, Artificial Sequence
  dgRNA
  Mis18bp1
gcaaccgaggggctt

SEQ ID NO: 67013 - DNA, 15 bp, Artificial Sequence
  dgRNA
  Gabarapl1
atttttgcgtttcga

SEQ ID NO: 67014 - DNA, 15 bp, Artificial Sequence
  dgRNA
  Gabarapl1
tgcgtttcgatggag

SEQ ID NO: 67015 - DNA, 15 bp, Artificial Sequence
  dgRNA
  Gabarapl1
tcgatggagtggttt

SEQ ID NO: 67016 - DNA, 15 bp, Artificial Sequence
  dgRNA
  Gabarapl1
ccacccggatccagc

SEQ ID NO: 67017 - DNA, 15 bp, Artificial Sequence
  dgRNA
  Olfr821
cccaaccttgcattt

SEQ ID NO: 67018 - DNA, 15 bp, Artificial Sequence
  dgRNA
  Olfr821
cctaaatgcaaggtt

SEQ ID NO: 67019 - DNA, 15 bp, Artificial Sequence
  dgRNA
  Olfr821
gattgcctgaagtag

SEQ ID NO: 67020 - DNA, 15 bp, Artificial Sequence
  dgRNA
  Olfr821
tgattgcctgaagta

SEQ ID NO: 67021 - DNA, 15 bp, Artificial Sequence
  dgRNA
  Trpm8
tacttaggcactgca

SEQ ID NO: 67022 - DNA, 15 bp, Artificial Sequence
  dgRNA
  Trpm8
aaagaagcttagtgc

SEQ ID NO: 67023 - DNA, 15 bp, Artificial Sequence
  dgRNA
  Cd27
ggtttaccacccaag

SEQ ID NO: 67024 - DNA, 15 bp, Artificial Sequence
  dgRNA
  Cd27
caagtggagtcgcag

SEQ ID NO: 67025 - DNA, 15 bp, Artificial Sequence
  dgRNA
  Cd27
gcgactccacttggg

SEQ ID NO: 67026 - DNA, 15 bp, Artificial Sequence
  dgRNA
  Cd27
actgcgactccactt

SEQ ID NO: 67027 - DNA, 15 bp, Artificial Sequence
  dgRNA
  Snx18
ctcccacccaccacg

SEQ ID NO: 67028 - DNA, 15 bp, Artificial Sequence
  dgRNA
  Snx18
tccgtagccgccaca

SEQ ID NO: 67029 - DNA, 15 bp, Artificial Sequence
  dgRNA
  Snx18
gtagccgccacaagg

SEQ ID NO: 67030 - DNA, 15 bp, Artificial Sequence
  dgRNA
  Snx18
acaaggtggcagcgg

SEQ ID NO: 67031 - DNA, 15 bp, Artificial Sequence
  dgRNA
  4930596D02Rik
gtctattgtatacct

SEQ ID NO: 67032 - DNA, 15 bp, Artificial Sequence
  dgRNA
  4930596D02Rik
ctcaattgctcccag

SEQ ID NO: 67033 - DNA, 15 bp, Artificial Sequence
  dgRNA
  4930596D02Rik
catctataacttccc

SEQ ID NO: 67034 - DNA, 15 bp, Artificial Sequence
  dgRNA
  4930596D02Rik
gtccctttatcagaa

SEQ ID NO: 67035 - DNA, 15 bp, Artificial Sequence
  dgRNA
  Tmem38b
ttgcccgttgcccct

SEQ ID NO: 67036 - DNA, 15 bp, Artificial Sequence
  dgRNA
  Tmem38b
tgcccgttgcccctt

SEQ ID NO: 67037 - DNA, 15 bp, Artificial Sequence
  dgRNA
  Tmem38b
gccccttgggtcagc

SEQ ID NO: 67038 - DNA, 15 bp, Artificial Sequence
  dgRNA
  Tmem38b
ttttttaggagaacc

SEQ ID NO: 67039 - DNA, 15 bp, Artificial Sequence
  dgRNA
  Ash2l
tactgcgacagttgc

SEQ ID NO: 67040 - DNA, 15 bp, Artificial Sequence
  dgRNA
  Ash2l
tggttaatacatagc

SEQ ID NO: 67041 - DNA, 15 bp, Artificial Sequence
  dgRNA
  Zc3h12d
gaacgtgccttgcgc

SEQ ID NO: 67042 - DNA, 15 bp, Artificial Sequence
  dgRNA
  Zc3h12d
gccttgcgcaggaag

SEQ ID NO: 67043 - DNA, 15 bp, Artificial Sequence
  dgRNA
  Zc3h12d
ggatcagcttctagc

SEQ ID NO: 67044 - DNA, 15 bp, Artificial Sequence
  dgRNA
  Zc3h12d
gatcagcttctagca

SEQ ID NO: 67045 - DNA, 15 bp, Artificial Sequence
  dgRNA
  Anapc11
gccctgccgcgaccc

SEQ ID NO: 67046 - DNA, 15 bp, Artificial Sequence
  dgRNA
  Anapc11
gcggcggcgcagtgc

SEQ ID NO: 67047 - DNA, 15 bp, Artificial Sequence
  dgRNA
  Anapc11
ctcccagggcggccg

SEQ ID NO: 67048 - DNA, 15 bp, Artificial Sequence
  dgRNA
  Anapc11
ggccggctcccaggg

SEQ ID NO: 67049 - DNA, 15 bp, Artificial Sequence
  dgRNA
  Spata31d1c
cctaggcctacagtg

SEQ ID NO: 67050 - DNA, 15 bp, Artificial Sequence
  dgRNA
  Spata31d1c
gttctgagattgcat

SEQ ID NO: 67051 - DNA, 15 bp, Artificial Sequence
  dgRNA
  Crem
ggagggtagggctcg

SEQ ID NO: 67052 - DNA, 15 bp, Artificial Sequence
  dgRNA
  Npy2r
catagcgtgcaacta

SEQ ID NO: 67053 - DNA, 15 bp, Artificial Sequence
  dgRNA
  Npy2r
gcgtgcaactaaggt

SEQ ID NO: 67054 - DNA, 15 bp, Artificial Sequence
  dgRNA
  Npy2r
tgcaactaaggttgg

SEQ ID NO: 67055 - DNA, 15 bp, Artificial Sequence
  dgRNA
  Npy2r
cagtctctgactacg

SEQ ID NO: 67056 - DNA, 15 bp, Artificial Sequence
  dgRNA
  Snx11
cctcccgtcgtgcac

SEQ ID NO: 67057 - DNA, 15 bp, Artificial Sequence
  dgRNA
  Snx11
ctcccgtcgtgcacc

SEQ ID NO: 67058 - DNA, 15 bp, Artificial Sequence
  dgRNA
  Snx11
tcccgtcgtgcaccg

SEQ ID NO: 67059 - DNA, 15 bp, Artificial Sequence
  dgRNA
  Snx11
cgtgcaccggggcac

SEQ ID NO: 67060 - DNA, 15 bp, Artificial Sequence
  dgRNA
  Olig2
ggcgtgtgccgggcc

SEQ ID NO: 67061 - DNA, 15 bp, Artificial Sequence
  dgRNA
  Olig2
gtgtgccgggcccgg

SEQ ID NO: 67062 - DNA, 15 bp, Artificial Sequence
  dgRNA
  Olig2
tgtgccgggcccggc

SEQ ID NO: 67063 - DNA, 15 bp, Artificial Sequence
  dgRNA
  Olig2
gcgggtttcattgag

SEQ ID NO: 67064 - DNA, 15 bp, Artificial Sequence
  dgRNA
  Slco1a4
ataagtgcttttcgt

SEQ ID NO: 67065 - DNA, 15 bp, Artificial Sequence
  dgRNA
  Samd11
ggaggacgccgcatc

SEQ ID NO: 67066 - DNA, 15 bp, Artificial Sequence
  dgRNA
  Samd11
gaggacgccgcatct

SEQ ID NO: 67067 - DNA, 15 bp, Artificial Sequence
  dgRNA
  Samd11
cgcatctgggcccct

SEQ ID NO: 67068 - DNA, 15 bp, Artificial Sequence
  dgRNA
  Samd11
catctgggcccctcg

SEQ ID NO: 67069 - DNA, 15 bp, Artificial Sequence
  dgRNA
  Lat2
accaccctagtagtc

SEQ ID NO: 67070 - DNA, 15 bp, Artificial Sequence
  dgRNA
  Lat2
ctagtagtctggccg

SEQ ID NO: 67071 - DNA, 15 bp, Artificial Sequence
  dgRNA
  Lat2
gtagtctggccgagg

SEQ ID NO: 67072 - DNA, 15 bp, Artificial Sequence
  dgRNA
  Lat2
agcgaagttaaagct

SEQ ID NO: 67073 - DNA, 15 bp, Artificial Sequence
  dgRNA
  Gm5142
tgtacacttcacaat

SEQ ID NO: 67074 - DNA, 15 bp, Artificial Sequence
  dgRNA
  Gm5142
gttactgactgaact

SEQ ID NO: 67075 - DNA, 15 bp, Artificial Sequence
  dgRNA
  Tmem123
tctcggaggcggatg

SEQ ID NO: 67076 - DNA, 15 bp, Artificial Sequence
  dgRNA
  Tmem123
cggggctctcggagg

SEQ ID NO: 67077 - DNA, 15 bp, Artificial Sequence
  dgRNA
  Tmem123
agcggataagaggcg

SEQ ID NO: 67078 - DNA, 15 bp, Artificial Sequence
  dgRNA
  Tmem123
gagcggataagaggc

SEQ ID NO: 67079 - DNA, 15 bp, Artificial Sequence
  dgRNA
  Cd3d
gtcttacaccatcaa

SEQ ID NO: 67080 - DNA, 15 bp, Artificial Sequence
  dgRNA
  Cd3d
ttctaggaagtgtaa

SEQ ID NO: 67081 - DNA, 15 bp, Artificial Sequence
  dgRNA
  Zbtb10
tgggccgggggcgcc

SEQ ID NO: 67082 - DNA, 15 bp, Artificial Sequence
  dgRNA
  Zbtb10
gtgggggccggccgg

SEQ ID NO: 67083 - DNA, 15 bp, Artificial Sequence
  dgRNA
  Zbtb10
ggtgggggccggccg

SEQ ID NO: 67084 - DNA, 15 bp, Artificial Sequence
  dgRNA
  Ppih
cctgccaccggaagc

SEQ ID NO: 67085 - DNA, 15 bp, Artificial Sequence
  dgRNA
  Ppih
aaacccggcttccgg

SEQ ID NO: 67086 - DNA, 15 bp, Artificial Sequence
  dgRNA
  Ppih
tagaaacccggcttc

SEQ ID NO: 67087 - DNA, 15 bp, Artificial Sequence
  dgRNA
  Cacna1b
tgcggtagcagctgg

SEQ ID NO: 67088 - DNA, 15 bp, Artificial Sequence
  dgRNA
  Cacna1b
gcggtagcagctggc

SEQ ID NO: 67089 - DNA, 15 bp, Artificial Sequence
  dgRNA
  Cacna1b
agcagctggcgggcg

SEQ ID NO: 67090 - DNA, 15 bp, Artificial Sequence
  dgRNA
  Cacna1b
tggcgggcgaggtcc

SEQ ID NO: 67091 - DNA, 15 bp, Artificial Sequence
  dgRNA
  Plscr5
agtctcgcccgtgat

SEQ ID NO: 67092 - DNA, 15 bp, Artificial Sequence
  dgRNA
  Plscr5
gaatcaacctatcac

SEQ ID NO: 67093 - DNA, 15 bp, Artificial Sequence
  dgRNA
  Plscr5
ctctggaatccgatg

SEQ ID NO: 67094 - DNA, 15 bp, Artificial Sequence
  dgRNA
  Lancl3
tgccctgcacgtccc

SEQ ID NO: 67095 - DNA, 15 bp, Artificial Sequence
  dgRNA
  Lancl3
agccgagggcggagc

SEQ ID NO: 67096 - DNA, 15 bp, Artificial Sequence
  dgRNA
  Lancl3
tggcgcggccccgcg

SEQ ID NO: 67097 - DNA, 15 bp, Artificial Sequence
  dgRNA
  Lancl3
ggcgcggccccgcgt

SEQ ID NO: 67098 - DNA, 15 bp, Artificial Sequence
  dgRNA
  E130311K13Rik
ggcttggtaccacca

SEQ ID NO: 67099 - DNA, 15 bp, Artificial Sequence
  dgRNA
  E130311K13Rik
tctgcgtgtccttgg

SEQ ID NO: 67100 - DNA, 15 bp, Artificial Sequence
  dgRNA
  Prr14
gagtgaatggtctac

SEQ ID NO: 67101 - DNA, 15 bp, Artificial Sequence
  dgRNA
  Prr14
gaatggtctaccggt

SEQ ID NO: 67102 - DNA, 15 bp, Artificial Sequence
  dgRNA
  Prr14
ttataacccagaatc

SEQ ID NO: 67103 - DNA, 15 bp, Artificial Sequence
  dgRNA
  Prr14
tttaggcctccccca

SEQ ID NO: 67104 - DNA, 15 bp, Artificial Sequence
  dgRNA
  Tmc8
gctggtcttaggagg

SEQ ID NO: 67105 - DNA, 15 bp, Artificial Sequence
  dgRNA
  Tmc8
ggagggggctcttcg

SEQ ID NO: 67106 - DNA, 15 bp, Artificial Sequence
  dgRNA
  Tmc8
gctcttcggggagct

SEQ ID NO: 67107 - DNA, 15 bp, Artificial Sequence
  dgRNA
  2700097O09Rik
gtgcagaactccgca

SEQ ID NO: 67108 - DNA, 15 bp, Artificial Sequence
  dgRNA
  2700097O09Rik
tgcagaactccgcaa

SEQ ID NO: 67109 - DNA, 15 bp, Artificial Sequence
  dgRNA
  2700097O09Rik
ctccgcaagggcgcg

SEQ ID NO: 67110 - DNA, 15 bp, Artificial Sequence
  dgRNA
  2700097O09Rik
aagggcgcgcggcct

SEQ ID NO: 67111 - DNA, 15 bp, Artificial Sequence
  dgRNA
  Cyp2d11
gggtcctccctatcc

SEQ ID NO: 67112 - DNA, 15 bp, Artificial Sequence
  dgRNA
  Cyp2d11
ggtcctccctatccc

SEQ ID NO: 67113 - DNA, 15 bp, Artificial Sequence
  dgRNA
  Cyp2d11
tggcccgggataggg

SEQ ID NO: 67114 - DNA, 15 bp, Artificial Sequence
  dgRNA
  Cyp2d11
ttttggcccgggata

SEQ ID NO: 67115 - DNA, 15 bp, Artificial Sequence
  dgRNA
  Pdxk
cgtgatggagcacag

SEQ ID NO: 67116 - DNA, 15 bp, Artificial Sequence
  dgRNA
  Pdxk
acaggtcccgttgcc

SEQ ID NO: 67117 - DNA, 15 bp, Artificial Sequence
  dgRNA
  Pdxk
ggtcccgttgcccgg

SEQ ID NO: 67118 - DNA, 15 bp, Artificial Sequence
  dgRNA
  Pdxk
gtcccgttgcccgga

SEQ ID NO: 67119 - DNA, 15 bp, Artificial Sequence
  dgRNA
  Olfr480
gagatctactgaaat

SEQ ID NO: 67120 - DNA, 15 bp, Artificial Sequence
  dgRNA
  Olfr480
tagttacatgtgtac

SEQ ID NO: 67121 - DNA, 15 bp, Artificial Sequence
  dgRNA
  Dse
gttggccgctagctt

SEQ ID NO: 67122 - DNA, 15 bp, Artificial Sequence
  dgRNA
  Dse
cgctagctttggtag

SEQ ID NO: 67123 - DNA, 15 bp, Artificial Sequence
  dgRNA
  Dse
gctagctttggtagt

SEQ ID NO: 67124 - DNA, 15 bp, Artificial Sequence
  dgRNA
  Dse
ttaaagcgctggaag

SEQ ID NO: 67125 - DNA, 15 bp, Artificial Sequence
  dgRNA
  Dpp6
gggcgcccggtgacc

SEQ ID NO: 67126 - DNA, 15 bp, Artificial Sequence
  dgRNA
  Dpp6
gcttgtagcgtccac

SEQ ID NO: 67127 - DNA, 15 bp, Artificial Sequence
  dgRNA
  Dpp6
gcctcaacccttccg

SEQ ID NO: 67128 - DNA, 15 bp, Artificial Sequence
  dgRNA
  Dpp6
gcatgcgcctttgcg

SEQ ID NO: 67129 - DNA, 15 bp, Artificial Sequence
  dgRNA
  Nhlrc4
ggcctatagttgtag

SEQ ID NO: 67130 - DNA, 15 bp, Artificial Sequence
  dgRNA
  Nhlrc4
tcctgtcttgcccga

SEQ ID NO: 67131 - DNA, 15 bp, Artificial Sequence
  dgRNA
  Nhlrc4
tagacccaagccaga

SEQ ID NO: 67132 - DNA, 15 bp, Artificial Sequence
  dgRNA
  Nhlrc4
tcaatttgtccctgc

SEQ ID NO: 67133 - DNA, 15 bp, Artificial Sequence
  dgRNA
  Grin2b
gaggcaccacggcct

SEQ ID NO: 67134 - DNA, 15 bp, Artificial Sequence
  dgRNA
  Grin2b
aggcaccacggcctc

SEQ ID NO: 67135 - DNA, 15 bp, Artificial Sequence
  dgRNA
  Grin2b
cttaacccgaggccg

SEQ ID NO: 67136 - DNA, 15 bp, Artificial Sequence
  dgRNA
  Grin2b
gaaaagcttaacccg

SEQ ID NO: 67137 - DNA, 15 bp, Artificial Sequence
  dgRNA
  Calca
cctcccgactcacca

SEQ ID NO: 67138 - DNA, 15 bp, Artificial Sequence
  dgRNA
  Calca
cccgactcaccacgg

SEQ ID NO: 67139 - DNA, 15 bp, Artificial Sequence
  dgRNA
  Calca
ccgactcaccacggc

SEQ ID NO: 67140 - DNA, 15 bp, Artificial Sequence
  dgRNA
  Calca
tcgggaggggtctcg

SEQ ID NO: 67141 - DNA, 15 bp, Artificial Sequence
  dgRNA
  Eml5
cgggtgcttagatct

SEQ ID NO: 67142 - DNA, 15 bp, Artificial Sequence
  dgRNA
  Eml5
gcttagatcttggta

SEQ ID NO: 67143 - DNA, 15 bp, Artificial Sequence
  dgRNA
  Eml5
tagatcttggtaggg

SEQ ID NO: 67144 - DNA, 15 bp, Artificial Sequence
  dgRNA
  Eml5
gtagggaggactgcg

SEQ ID NO: 67145 - DNA, 15 bp, Artificial Sequence
  dgRNA
  Acot9
tttacttaacaatgg

SEQ ID NO: 67146 - DNA, 15 bp, Artificial Sequence
  dgRNA
  Acot9
acctagctgattgag

SEQ ID NO: 67147 - DNA, 15 bp, Artificial Sequence
  dgRNA
  Acot9
cctagctgattgagt

SEQ ID NO: 67148 - DNA, 15 bp, Artificial Sequence
  dgRNA
  Acot9
gaccaatcaaatagc

SEQ ID NO: 67149 - DNA, 15 bp, Artificial Sequence
  dgRNA
  Rab9
cttagccttagcggt

SEQ ID NO: 67150 - DNA, 15 bp, Artificial Sequence
  dgRNA
  Rab9
ttagccttagcggtt

SEQ ID NO: 67151 - DNA, 15 bp, Artificial Sequence
  dgRNA
  Rab9
tgggctcgcagccgc

SEQ ID NO: 67152 - DNA, 15 bp, Artificial Sequence
  dgRNA
  Rab9
cgtttcttctaacag

SEQ ID NO: 67153 - DNA, 15 bp, Artificial Sequence
  dgRNA
  Rundc3b
cccacctctcgtcat

SEQ ID NO: 67154 - DNA, 15 bp, Artificial Sequence
  dgRNA
  Rundc3b
tggctctctccgtag

SEQ ID NO: 67155 - DNA, 15 bp, Artificial Sequence
  dgRNA
  Rundc3b
cggccttgttcccat

SEQ ID NO: 67156 - DNA, 15 bp, Artificial Sequence
  dgRNA
  Rundc3b
tcccataggtgcagg

SEQ ID NO: 67157 - DNA, 15 bp, Artificial Sequence
  dgRNA
  Ddx19b
gtgactttccgcctt

SEQ ID NO: 67158 - DNA, 15 bp, Artificial Sequence
  dgRNA
  Ddx19b
gacgatctgcagcga

SEQ ID NO: 67159 - DNA, 15 bp, Artificial Sequence
  dgRNA
  Ddx19b
acgatctgcagcgaa

SEQ ID NO: 67160 - DNA, 15 bp, Artificial Sequence
  dgRNA
  Ddx19b
tgcagcgaagggtga

SEQ ID NO: 67161 - DNA, 15 bp, Artificial Sequence
  dgRNA
  F2rl3
cacagggaccttcga

SEQ ID NO: 67162 - DNA, 15 bp, Artificial Sequence
  dgRNA
  F2rl3
acagggaccttcgat

SEQ ID NO: 67163 - DNA, 15 bp, Artificial Sequence
  dgRNA
  F2rl3
ccttcgatgggctcc

SEQ ID NO: 67164 - DNA, 15 bp, Artificial Sequence
  dgRNA
  F2rl3
cttcgatgggctcca

SEQ ID NO: 67165 - DNA, 15 bp, Artificial Sequence
  dgRNA
  Vps45
tccccgcccattgca

SEQ ID NO: 67166 - DNA, 15 bp, Artificial Sequence
  dgRNA
  Vps45
ccattgcaggggccc

SEQ ID NO: 67167 - DNA, 15 bp, Artificial Sequence
  dgRNA
  Vps45
gacagttaattcatt

SEQ ID NO: 67168 - DNA, 15 bp, Artificial Sequence
  dgRNA
  Vps45
ggacagttaattcat

SEQ ID NO: 67169 - DNA, 15 bp, Artificial Sequence
  dgRNA
  Rab20
ggagtaataggaacg

SEQ ID NO: 67170 - DNA, 15 bp, Artificial Sequence
  dgRNA
  Rab20
taataggaacgaggc

SEQ ID NO: 67171 - DNA, 15 bp, Artificial Sequence
  dgRNA
  Rab20
cgaggcaggggtgat

SEQ ID NO: 67172 - DNA, 15 bp, Artificial Sequence
  dgRNA
  Rab20
gggcctaggcggacc

SEQ ID NO: 67173 - DNA, 15 bp, Artificial Sequence
  dgRNA
  Wdr43
tcgcgcttccttcgc

SEQ ID NO: 67174 - DNA, 15 bp, Artificial Sequence
  dgRNA
  Wdr43
tgagccaccgtccac

SEQ ID NO: 67175 - DNA, 15 bp, Artificial Sequence
  dgRNA
  Wdr43
gagccaccgtccaca

SEQ ID NO: 67176 - DNA, 15 bp, Artificial Sequence
  dgRNA
  Wdr43
ccaccgtccacaggg

SEQ ID NO: 67177 - DNA, 15 bp, Artificial Sequence
  dgRNA
  Smyd4
tgagcttctctgccg

SEQ ID NO: 67178 - DNA, 15 bp, Artificial Sequence
  dgRNA
  Smyd4
tctgccggggtcccg

SEQ ID NO: 67179 - DNA, 15 bp, Artificial Sequence
  dgRNA
  Smyd4
ctgccggggtcccgc

SEQ ID NO: 67180 - DNA, 15 bp, Artificial Sequence
  dgRNA
  Smyd4
gggctgctcaacgat

SEQ ID NO: 67181 - DNA, 15 bp, Artificial Sequence
  dgRNA
  Eif4g2
gagccttcgcgaata

SEQ ID NO: 67182 - DNA, 15 bp, Artificial Sequence
  dgRNA
  Eif4g2
tggctttgcgcactg

SEQ ID NO: 67183 - DNA, 15 bp, Artificial Sequence
  dgRNA
  Eif4g2
ttgcgcactgcggcg

SEQ ID NO: 67184 - DNA, 15 bp, Artificial Sequence
  dgRNA
  Eif4g2
accgagcttgcccgc

SEQ ID NO: 67185 - DNA, 15 bp, Artificial Sequence
  dgRNA
  Sfn
cttgtgacctcaaac

SEQ ID NO: 67186 - DNA, 15 bp, Artificial Sequence
  dgRNA
  Sfn
gacctcaaactggtt

SEQ ID NO: 67187 - DNA, 15 bp, Artificial Sequence
  dgRNA
  Sfn
cctacagagccaatt

SEQ ID NO: 67188 - DNA, 15 bp, Artificial Sequence
  dgRNA
  Sfn
acagagccaattcgg

SEQ ID NO: 67189 - DNA, 15 bp, Artificial Sequence
  dgRNA
  Sacm1l
ctccaatccgcgcat

SEQ ID NO: 67190 - DNA, 15 bp, Artificial Sequence
  dgRNA
  Sacm1l
caatccgcgcatcgg

SEQ ID NO: 67191 - DNA, 15 bp, Artificial Sequence
  dgRNA
  Sacm1l
tggtttgtccgccgc

SEQ ID NO: 67192 - DNA, 15 bp, Artificial Sequence
  dgRNA
  Sacm1l
ccgtgctcgcccgag

SEQ ID NO: 67193 - DNA, 15 bp, Artificial Sequence
  dgRNA
  Asb7
actgtcgcgaatccg

SEQ ID NO: 67194 - DNA, 15 bp, Artificial Sequence
  dgRNA
  Asb7
ctgtcgcgaatccgc

SEQ ID NO: 67195 - DNA, 15 bp, Artificial Sequence
  dgRNA
  Asb7
ctttacgacagccag

SEQ ID NO: 67196 - DNA, 15 bp, Artificial Sequence
  dgRNA
  Asb7
tttacgacagccagg

SEQ ID NO: 67197 - DNA, 15 bp, Artificial Sequence
  dgRNA
  Irf2bp1
cgaaccccagcttcc

SEQ ID NO: 67198 - DNA, 15 bp, Artificial Sequence
  dgRNA
  Irf2bp1
aagaagcagccccga

SEQ ID NO: 67199 - DNA, 15 bp, Artificial Sequence
  dgRNA
  Irf2bp1
tcataaatgctcggg

SEQ ID NO: 67200 - DNA, 15 bp, Artificial Sequence
  dgRNA
  Irf2bp1
gtttcataaatgctc

SEQ ID NO: 67201 - DNA, 15 bp, Artificial Sequence
  dgRNA
  Prl8a1
catccagacacgtat

SEQ ID NO: 67202 - DNA, 15 bp, Artificial Sequence
  dgRNA
  Prl8a1
acacctatacgtgtc

SEQ ID NO: 67203 - DNA, 15 bp, Artificial Sequence
  dgRNA
  Prl8a1
agcacataatcccaa

SEQ ID NO: 67204 - DNA, 15 bp, Artificial Sequence
  dgRNA
  Prl8a1
tagcacataatccca

SEQ ID NO: 67205 - DNA, 15 bp, Artificial Sequence
  dgRNA
  Tiam2
gaagggggtcccggc

SEQ ID NO: 67206 - DNA, 15 bp, Artificial Sequence
  dgRNA
  Tiam2
aagggggtcccggcc

SEQ ID NO: 67207 - DNA, 15 bp, Artificial Sequence
  dgRNA
  Tiam2
ggggtcccggccggg

SEQ ID NO: 67208 - DNA, 15 bp, Artificial Sequence
  dgRNA
  Tiam2
ccgggaggcgtggcg

SEQ ID NO: 67209 - DNA, 15 bp, Artificial Sequence
  dgRNA
  Aco2
gttgcattctgtgtt

SEQ ID NO: 67210 - DNA, 15 bp, Artificial Sequence
  dgRNA
  Aco2
ccaagtatgttgatt

SEQ ID NO: 67211 - DNA, 15 bp, Artificial Sequence
  dgRNA
  Aco2
ccaaatcaacatact

SEQ ID NO: 67212 - DNA, 15 bp, Artificial Sequence
  dgRNA
  Astl
tcagccaagatggat

SEQ ID NO: 67213 - DNA, 15 bp, Artificial Sequence
  dgRNA
  Astl
ggactatggtccaga

SEQ ID NO: 67214 - DNA, 15 bp, Artificial Sequence
  dgRNA
  Astl
tcctctggtaagact

SEQ ID NO: 67215 - DNA, 15 bp, Artificial Sequence
  dgRNA
  Astl
tcaggtgatagttgt

SEQ ID NO: 67216 - DNA, 15 bp, Artificial Sequence
  dgRNA
  Chsy3
gcgcttccccacgcc

SEQ ID NO: 67217 - DNA, 15 bp, Artificial Sequence
  dgRNA
  Chsy3
ctggcagccacgacg

SEQ ID NO: 67218 - DNA, 15 bp, Artificial Sequence
  dgRNA
  Chsy3
tggcagccacgacgc

SEQ ID NO: 67219 - DNA, 15 bp, Artificial Sequence
  dgRNA
  Chsy3
cagccacgacgcggg

SEQ ID NO: 67220 - DNA, 15 bp, Artificial Sequence
  dgRNA
  Ypel5
agggcgagcccgaga

SEQ ID NO: 67221 - DNA, 15 bp, Artificial Sequence
  dgRNA
  Ypel5
gggcgagcccgagaa

SEQ ID NO: 67222 - DNA, 15 bp, Artificial Sequence
  dgRNA
  Ypel5
ggcgagcccgagaag

SEQ ID NO: 67223 - DNA, 15 bp, Artificial Sequence
  dgRNA
  Ypel5
gcccgagaaggggcg

SEQ ID NO: 67224 - DNA, 15 bp, Artificial Sequence
  dgRNA
  Ubc
tcgtttttccaaatc

SEQ ID NO: 67225 - DNA, 15 bp, Artificial Sequence
  dgRNA
  Ubc
cgtttttccaaatcg

SEQ ID NO: 67226 - DNA, 15 bp, Artificial Sequence
  dgRNA
  Ubc
ggcatagtgacccgc

SEQ ID NO: 67227 - DNA, 15 bp, Artificial Sequence
  dgRNA
  Ubc
gcatagtgacccgcc

SEQ ID NO: 67228 - DNA, 15 bp, Artificial Sequence
  dgRNA
  Itga1
tccattctgcgcagc

SEQ ID NO: 67229 - DNA, 15 bp, Artificial Sequence
  dgRNA
  Itga1
tgcgcagctggacac

SEQ ID NO: 67230 - DNA, 15 bp, Artificial Sequence
  dgRNA
  Itga1
caaggagtaaaagcc

SEQ ID NO: 67231 - DNA, 15 bp, Artificial Sequence
  dgRNA
  Itga1
ctttctacccagatc

SEQ ID NO: 67232 - DNA, 15 bp, Artificial Sequence
  dgRNA
  Tceanc2
ctttccccgcccctc

SEQ ID NO: 67233 - DNA, 15 bp, Artificial Sequence
  dgRNA
  Tceanc2
cccggtccgcccaat

SEQ ID NO: 67234 - DNA, 15 bp, Artificial Sequence
  dgRNA
  Tceanc2
caatcggctgcctcc

SEQ ID NO: 67235 - DNA, 15 bp, Artificial Sequence
  dgRNA
  Tceanc2
ctcctggccggtctc

SEQ ID NO: 67236 - DNA, 15 bp, Artificial Sequence
  dgRNA
  Vmn2r8
ttgaatatgactaag

SEQ ID NO: 67237 - DNA, 15 bp, Artificial Sequence
  dgRNA
  Vmn2r8
tcatcgggaaaattc

SEQ ID NO: 67238 - DNA, 15 bp, Artificial Sequence
  dgRNA
  Vmn2r8
tcattctatgtcatc

SEQ ID NO: 67239 - DNA, 15 bp, Artificial Sequence
  dgRNA
  Galnt6
agttcgctcacagca

SEQ ID NO: 67240 - DNA, 15 bp, Artificial Sequence
  dgRNA
  Galnt6
gttcgctcacagcaa

SEQ ID NO: 67241 - DNA, 15 bp, Artificial Sequence
  dgRNA
  Galnt6
cgctcacagcaaggg

SEQ ID NO: 67242 - DNA, 15 bp, Artificial Sequence
  dgRNA
  Galnt6
gagctcacccactgg

SEQ ID NO: 67243 - DNA, 15 bp, Artificial Sequence
  dgRNA
  Zfp114
aaaaaagatttccgg

SEQ ID NO: 67244 - DNA, 15 bp, Artificial Sequence
  dgRNA
  Zfp114
cttggaacttattga

SEQ ID NO: 67245 - DNA, 15 bp, Artificial Sequence
  dgRNA
  Zfp114
aagggcactatagtt

SEQ ID NO: 67246 - DNA, 15 bp, Artificial Sequence
  dgRNA
  Zfp114
tctactgaagcattc

SEQ ID NO: 67247 - DNA, 15 bp, Artificial Sequence
  dgRNA
  Tmem9
tcttggcaactagcg

SEQ ID NO: 67248 - DNA, 15 bp, Artificial Sequence
  dgRNA
  Tmem9
ggcaactagcgaggt

SEQ ID NO: 67249 - DNA, 15 bp, Artificial Sequence
  dgRNA
  Tmem9
gcaactagcgaggtt

SEQ ID NO: 67250 - DNA, 15 bp, Artificial Sequence
  dgRNA
  Tmem9
cgaggttgggctgag

SEQ ID NO: 67251 - DNA, 15 bp, Artificial Sequence
  dgRNA
  Sbspon
gagagtggccggtag

SEQ ID NO: 67252 - DNA, 15 bp, Artificial Sequence
  dgRNA
  Sbspon
agagtggccggtagc

SEQ ID NO: 67253 - DNA, 15 bp, Artificial Sequence
  dgRNA
  Sbspon
gcacctggggtggtc

SEQ ID NO: 67254 - DNA, 15 bp, Artificial Sequence
  dgRNA
  Sbspon
cacctggggtggtcg

SEQ ID NO: 67255 - DNA, 15 bp, Artificial Sequence
  dgRNA
  Rdh7
agatgagccttggac

SEQ ID NO: 67256 - DNA, 15 bp, Artificial Sequence
  dgRNA
  Rdh7
ttggactggaccatg

SEQ ID NO: 67257 - DNA, 15 bp, Artificial Sequence
  dgRNA
  Rdh7
gacacattacaggag

SEQ ID NO: 67258 - DNA, 15 bp, Artificial Sequence
  dgRNA
  Rdh7
attacataggcccca

SEQ ID NO: 67259 - DNA, 15 bp, Artificial Sequence
  dgRNA
  Ddx3y
ccggcagttaaatag

SEQ ID NO: 67260 - DNA, 15 bp, Artificial Sequence
  dgRNA
  Ddx3y
gtcagtttaattatc

SEQ ID NO: 67261 - DNA, 15 bp, Artificial Sequence
  dgRNA
  Ddx3y
tagagtttaagtaac

SEQ ID NO: 67262 - DNA, 15 bp, Artificial Sequence
  dgRNA
  Ddx3y
ctatttaactgccgg

SEQ ID NO: 67263 - DNA, 15 bp, Artificial Sequence
  dgRNA
  Olfr74
cctatagtctgtctg

SEQ ID NO: 67264 - DNA, 15 bp, Artificial Sequence
  dgRNA
  Olfr74
ctttacttatcctac

SEQ ID NO: 67265 - DNA, 15 bp, Artificial Sequence
  dgRNA
  Olfr74
tcttcatactcttac

SEQ ID NO: 67266 - DNA, 15 bp, Artificial Sequence
  dgRNA
  Olfr74
gcatatgaaacctgt

SEQ ID NO: 67267 - DNA, 15 bp, Artificial Sequence
  dgRNA
  Gm21975
ccctccccattcagg

SEQ ID NO: 67268 - DNA, 15 bp, Artificial Sequence
  dgRNA
  Gm21975
tccccattcaggggg

SEQ ID NO: 67269 - DNA, 15 bp, Artificial Sequence
  dgRNA
  Gm21975
ccccctgaatgggga

SEQ ID NO: 67270 - DNA, 15 bp, Artificial Sequence
  dgRNA
  Gm21975
accccctgaatgggg

SEQ ID NO: 67271 - DNA, 15 bp, Artificial Sequence
  dgRNA
  Sec14l4
acacctcttgagatc

SEQ ID NO: 67272 - DNA, 15 bp, Artificial Sequence
  dgRNA
  Sec14l4
ctgtccccttaaggt

SEQ ID NO: 67273 - DNA, 15 bp, Artificial Sequence
  dgRNA
  Sec14l4
cagggattctccctt

SEQ ID NO: 67274 - DNA, 15 bp, Artificial Sequence
  dgRNA
  Sec14l4
agggattctcccttg

SEQ ID NO: 67275 - DNA, 15 bp, Artificial Sequence
  dgRNA
  Rccd1
attccctatatggct

SEQ ID NO: 67276 - DNA, 15 bp, Artificial Sequence
  dgRNA
  Rccd1
acaccggtttcttag

SEQ ID NO: 67277 - DNA, 15 bp, Artificial Sequence
  dgRNA
  Rccd1
cggtttcttagaggc

SEQ ID NO: 67278 - DNA, 15 bp, Artificial Sequence
  dgRNA
  Rccd1
tgggccaatcagtga

SEQ ID NO: 67279 - DNA, 15 bp, Artificial Sequence
  dgRNA
  Cnih2
tctcagccccgcccg

SEQ ID NO: 67280 - DNA, 15 bp, Artificial Sequence
  dgRNA
  Cnih2
cccgaggccgctgca

SEQ ID NO: 67281 - DNA, 15 bp, Artificial Sequence
  dgRNA
  Cnih2
gaggccgctgcacgg

SEQ ID NO: 67282 - DNA, 15 bp, Artificial Sequence
  dgRNA
  Cnih2
gccccgccggcttcg

SEQ ID NO: 67283 - DNA, 15 bp, Artificial Sequence
  dgRNA
  Crabp1
agaatgtgggcggcg

SEQ ID NO: 67284 - DNA, 15 bp, Artificial Sequence
  dgRNA
  Crabp1
atgtgggcggcgtgg

SEQ ID NO: 67285 - DNA, 15 bp, Artificial Sequence
  dgRNA
  Crabp1
aagttgcatcactag

SEQ ID NO: 67286 - DNA, 15 bp, Artificial Sequence
  dgRNA
  Crabp1
gtgaggggcgcctta

SEQ ID NO: 67287 - DNA, 15 bp, Artificial Sequence
  dgRNA
  Ubxn11
gggttcaacatcttc

SEQ ID NO: 67288 - DNA, 15 bp, Artificial Sequence
  dgRNA
  Ubxn11
ggtctagaggcttct

SEQ ID NO: 67289 - DNA, 15 bp, Artificial Sequence
  dgRNA
  Ubxn11
gtctagaggcttcta

SEQ ID NO: 67290 - DNA, 15 bp, Artificial Sequence
  dgRNA
  Ubxn11
tagagcggtgcattc

SEQ ID NO: 67291 - DNA, 15 bp, Artificial Sequence
  dgRNA
  Kdm5d
atttatctaagcagt

SEQ ID NO: 67292 - DNA, 15 bp, Artificial Sequence
  dgRNA
  Kdm5d
aaacgaaacgaccaa

SEQ ID NO: 67293 - DNA, 15 bp, Artificial Sequence
  dgRNA
  Kdm5d
agtcgtttcacacat

SEQ ID NO: 67294 - DNA, 15 bp, Artificial Sequence
  dgRNA
  Kdm5d
cgttatttataaatc

SEQ ID NO: 67295 - DNA, 15 bp, Artificial Sequence
  dgRNA
  Sppl2a
tctgtggatcttaac

SEQ ID NO: 67296 - DNA, 15 bp, Artificial Sequence
  dgRNA
  Sppl2a
gtggatcttaacggg

SEQ ID NO: 67297 - DNA, 15 bp, Artificial Sequence
  dgRNA
  Sppl2a
tggatcttaacgggt

SEQ ID NO: 67298 - DNA, 15 bp, Artificial Sequence
  dgRNA
  Sppl2a
gagaggagcctcgtc

SEQ ID NO: 67299 - DNA, 15 bp, Artificial Sequence
  dgRNA
  Aldh3a2
ctcctagaggacgct

SEQ ID NO: 67300 - DNA, 15 bp, Artificial Sequence
  dgRNA
  Aldh3a2
ttgcacctacacacc

SEQ ID NO: 67301 - DNA, 15 bp, Artificial Sequence
  dgRNA
  Aldh3a2
tacacacccggcgcc

SEQ ID NO: 67302 - DNA, 15 bp, Artificial Sequence
  dgRNA
  Aldh3a2
acacacccggcgccc

SEQ ID NO: 67303 - DNA, 15 bp, Artificial Sequence
  dgRNA
  12-Sep
aggtattggggtcaa

SEQ ID NO: 67304 - DNA, 15 bp, Artificial Sequence
  dgRNA
  12-Sep
ccccaatacctggca

SEQ ID NO: 67305 - DNA, 15 bp, Artificial Sequence
  dgRNA
  12-Sep
cttgaccccaatacc

SEQ ID NO: 67306 - DNA, 15 bp, Artificial Sequence
  dgRNA
  12-Sep
acccccccctcaggc

SEQ ID NO: 67307 - DNA, 15 bp, Artificial Sequence
  dgRNA
  Rpl13
acggggaaaaaacac

SEQ ID NO: 67308 - DNA, 15 bp, Artificial Sequence
  dgRNA
  Rpl13
acactggatctagga

SEQ ID NO: 67309 - DNA, 15 bp, Artificial Sequence
  dgRNA
  Rpl13
aggggtttaattcat

SEQ ID NO: 67310 - DNA, 15 bp, Artificial Sequence
  dgRNA
  Rpl13
ccacactgcgaagtt

SEQ ID NO: 67311 - DNA, 15 bp, Artificial Sequence
  dgRNA
  Morn2
cgcacatgccacgtc

SEQ ID NO: 67312 - DNA, 15 bp, Artificial Sequence
  dgRNA
  Morn2
acgtcaggccgtacc

SEQ ID NO: 67313 - DNA, 15 bp, Artificial Sequence
  dgRNA
  Morn2
ggctcgtagcgttgc

SEQ ID NO: 67314 - DNA, 15 bp, Artificial Sequence
  dgRNA
  Morn2
tagcgttgctggctg

SEQ ID NO: 67315 - DNA, 15 bp, Artificial Sequence
  dgRNA
  Ppp2r2b
acgggagaaaggtag

SEQ ID NO: 67316 - DNA, 15 bp, Artificial Sequence
  dgRNA
  Ppp2r2b
cagcgtgtgtttaca

SEQ ID NO: 67317 - DNA, 15 bp, Artificial Sequence
  dgRNA
  Ppp2r2b
agccggacacgggag

SEQ ID NO: 67318 - DNA, 15 bp, Artificial Sequence
  dgRNA
  Ppp2r2b
agtgcagccggacac

SEQ ID NO: 67319 - DNA, 15 bp, Artificial Sequence
  dgRNA
  Mrpl42
agcgattttgttgtc

SEQ ID NO: 67320 - DNA, 15 bp, Artificial Sequence
  dgRNA
  Mrpl42
gcgattttgttgtct

SEQ ID NO: 67321 - DNA, 15 bp, Artificial Sequence
  dgRNA
  Mrpl42
gaatcctgagtccaa

SEQ ID NO: 67322 - DNA, 15 bp, Artificial Sequence
  dgRNA
  Mrpl42
gcgtatagcgcgcgc

SEQ ID NO: 67323 - DNA, 15 bp, Artificial Sequence
  dgRNA
  Gabrr1
atttagacccgcccc

SEQ ID NO: 67324 - DNA, 15 bp, Artificial Sequence
  dgRNA
  Gabrr1
tttagacccgcccca

SEQ ID NO: 67325 - DNA, 15 bp, Artificial Sequence
  dgRNA
  Gabrr1
cagggaccgtcccgc

SEQ ID NO: 67326 - DNA, 15 bp, Artificial Sequence
  dgRNA
  Gabrr1
cgtcccgcaggacac

SEQ ID NO: 67327 - DNA, 15 bp, Artificial Sequence
  dgRNA
  Spats2l
gctagggagggcgtg

SEQ ID NO: 67328 - DNA, 15 bp, Artificial Sequence
  dgRNA
  Spats2l
gaacgtgcgtgtgag

SEQ ID NO: 67329 - DNA, 15 bp, Artificial Sequence
  dgRNA
  Spats2l
gcggatacaaaaccc

SEQ ID NO: 67330 - DNA, 15 bp, Artificial Sequence
  dgRNA
  Spats2l
cggatacaaaaccca

SEQ ID NO: 67331 - DNA, 15 bp, Artificial Sequence
  dgRNA
  Ccnyl1
agctgggccggcgcg

SEQ ID NO: 67332 - DNA, 15 bp, Artificial Sequence
  dgRNA
  Ccnyl1
ctgggccggcgcgcg

SEQ ID NO: 67333 - DNA, 15 bp, Artificial Sequence
  dgRNA
  Ccnyl1
agtccgaggtctacg

SEQ ID NO: 67334 - DNA, 15 bp, Artificial Sequence
  dgRNA
  Ccnyl1
ccgaggtctacgagg

SEQ ID NO: 67335 - DNA, 15 bp, Artificial Sequence
  dgRNA
  Phactr2
atgacaggcatccgc

SEQ ID NO: 67336 - DNA, 15 bp, Artificial Sequence
  dgRNA
  Phactr2
tgacaggcatccgct

SEQ ID NO: 67337 - DNA, 15 bp, Artificial Sequence
  dgRNA
  Phactr2
tccgctgggccggct

SEQ ID NO: 67338 - DNA, 15 bp, Artificial Sequence
  dgRNA
  Phactr2
gctgggccggcttgg

SEQ ID NO: 67339 - DNA, 15 bp, Artificial Sequence
  dgRNA
  Rundc1
gaagttacttgttct

SEQ ID NO: 67340 - DNA, 15 bp, Artificial Sequence
  dgRNA
  Rundc1
tgcattaaagtcccg

SEQ ID NO: 67341 - DNA, 15 bp, Artificial Sequence
  dgRNA
  Rundc1
gcattaaagtcccga

SEQ ID NO: 67342 - DNA, 15 bp, Artificial Sequence
  dgRNA
  Rundc1
cattaaagtcccgag

SEQ ID NO: 67343 - DNA, 15 bp, Artificial Sequence
  dgRNA
  Zfy2
tcaggcagtctaatc

SEQ ID NO: 67344 - DNA, 15 bp, Artificial Sequence
  dgRNA
  Zfy2
gacaatgatataacc

SEQ ID NO: 67345 - DNA, 15 bp, Artificial Sequence
  dgRNA
  Zfy2
atgatataaccaggg

SEQ ID NO: 67346 - DNA, 15 bp, Artificial Sequence
  dgRNA
  Zfy2
ggtctccctagccaa

SEQ ID NO: 67347 - DNA, 15 bp, Artificial Sequence
  dgRNA
  Ptges3l
gtaacccaggacgtg

SEQ ID NO: 67348 - DNA, 15 bp, Artificial Sequence
  dgRNA
  Ptges3l
acgtgaggacagccg

SEQ ID NO: 67349 - DNA, 15 bp, Artificial Sequence
  dgRNA
  Ptges3l
gaggacagccgcgga

SEQ ID NO: 67350 - DNA, 15 bp, Artificial Sequence
  dgRNA
  Ptges3l
tcttcgagctcgcgc

SEQ ID NO: 67351 - DNA, 15 bp, Artificial Sequence
  dgRNA
  Ubap2
tagtgggttctctat

SEQ ID NO: 67352 - DNA, 15 bp, Artificial Sequence
  dgRNA
  Ubap2
tgggttctctatagg

SEQ ID NO: 67353 - DNA, 15 bp, Artificial Sequence
  dgRNA
  Ubap2
gttctctataggcgg

SEQ ID NO: 67354 - DNA, 15 bp, Artificial Sequence
  dgRNA
  Ubap2
tcaatcttcaagtac

SEQ ID NO: 67355 - DNA, 15 bp, Artificial Sequence
  dgRNA
  Tmem54
ctcggcaacgcgcgc

SEQ ID NO: 67356 - DNA, 15 bp, Artificial Sequence
  dgRNA
  Tmem54
acgcgcgcaggacgc

SEQ ID NO: 67357 - DNA, 15 bp, Artificial Sequence
  dgRNA
  Tmem54
cgcgcgcaggacgcc

SEQ ID NO: 67358 - DNA, 15 bp, Artificial Sequence
  dgRNA
  Tmem54
cgcaggacgccgggc

SEQ ID NO: 67359 - DNA, 15 bp, Artificial Sequence
  dgRNA
  Jmjd1c
taatgtgactcgtgc

SEQ ID NO: 67360 - DNA, 15 bp, Artificial Sequence
  dgRNA
  Jmjd1c
tcagcacctgtgacg

SEQ ID NO: 67361 - DNA, 15 bp, Artificial Sequence
  dgRNA
  Jmjd1c
cagcacctgtgacgg

SEQ ID NO: 67362 - DNA, 15 bp, Artificial Sequence
  dgRNA
  Jmjd1c
tgcggccatagagac

SEQ ID NO: 67363 - DNA, 15 bp, Artificial Sequence
  dgRNA
  Ipo13
gtgtctcgatgtgct

SEQ ID NO: 67364 - DNA, 15 bp, Artificial Sequence
  dgRNA
  Ipo13
tgtgcttggccgtgc

SEQ ID NO: 67365 - DNA, 15 bp, Artificial Sequence
  dgRNA
  Ipo13
gtgcttggccgtgcc

SEQ ID NO: 67366 - DNA, 15 bp, Artificial Sequence
  dgRNA
  Ipo13
tggccgtgccgggcc

SEQ ID NO: 67367 - DNA, 15 bp, Artificial Sequence
  dgRNA
  Xpc
ctttccacctctcgc

SEQ ID NO: 67368 - DNA, 15 bp, Artificial Sequence
  dgRNA
  Xpc
acctctcgcgggaac

SEQ ID NO: 67369 - DNA, 15 bp, Artificial Sequence
  dgRNA
  Xpc
gccgccacgcactga

SEQ ID NO: 67370 - DNA, 15 bp, Artificial Sequence
  dgRNA
  Xpc
ccctcgtagtttgca

SEQ ID NO: 67371 - DNA, 15 bp, Artificial Sequence
  dgRNA
  Scd1
ttagcatttatcccc

SEQ ID NO: 67372 - DNA, 15 bp, Artificial Sequence
  dgRNA
  Scd1
atcccggcgcctcca

SEQ ID NO: 67373 - DNA, 15 bp, Artificial Sequence
  dgRNA
  Scd1
ctccaaggtctactc

SEQ ID NO: 67374 - DNA, 15 bp, Artificial Sequence
  dgRNA
  Scd1
agcccgtcttgtcat

SEQ ID NO: 67375 - DNA, 15 bp, Artificial Sequence
  dgRNA
  Vmn1r86
tatagtccattcatt

SEQ ID NO: 67376 - DNA, 15 bp, Artificial Sequence
  dgRNA
  Tfap2e
ccctttccgcagcca

SEQ ID NO: 67377 - DNA, 15 bp, Artificial Sequence
  dgRNA
  Tfap2e
cctttccgcagccaa

SEQ ID NO: 67378 - DNA, 15 bp, Artificial Sequence
  dgRNA
  Tfap2e
aatgcgcgcccccag

SEQ ID NO: 67379 - DNA, 15 bp, Artificial Sequence
  dgRNA
  Tfap2e
tataactagagtgca

SEQ ID NO: 67380 - DNA, 15 bp, Artificial Sequence
  dgRNA
  Tle1
gcgcacaggacgcgc

SEQ ID NO: 67381 - DNA, 15 bp, Artificial Sequence
  dgRNA
  Tle1
gtgccgcggtgcccg

SEQ ID NO: 67382 - DNA, 15 bp, Artificial Sequence
  dgRNA
  Tle1
gcgctctgagtgccg

SEQ ID NO: 67383 - DNA, 15 bp, Artificial Sequence
  dgRNA
  4921506M07Rik
gagacctctcatgaa

SEQ ID NO: 67384 - DNA, 15 bp, Artificial Sequence
  dgRNA
  4921506M07Rik
aagggtttaagctgc

SEQ ID NO: 67385 - DNA, 15 bp, Artificial Sequence
  dgRNA
  4921506M07Rik
taagctgctggaacc

SEQ ID NO: 67386 - DNA, 15 bp, Artificial Sequence
  dgRNA
  4921506M07Rik
gcaatccactgtgac

SEQ ID NO: 67387 - DNA, 15 bp, Artificial Sequence
  dgRNA
  Endov
cctgtcgctgtggaa

SEQ ID NO: 67388 - DNA, 15 bp, Artificial Sequence
  dgRNA
  Endov
gtcgtgcattagcca

SEQ ID NO: 67389 - DNA, 15 bp, Artificial Sequence
  dgRNA
  Endov
tcgtgcattagccaa

SEQ ID NO: 67390 - DNA, 15 bp, Artificial Sequence
  dgRNA
  Endov
cgtgcattagccaag

SEQ ID NO: 67391 - DNA, 15 bp, Artificial Sequence
  dgRNA
  Alg11
gcggcgtggcccaag

SEQ ID NO: 67392 - DNA, 15 bp, Artificial Sequence
  dgRNA
  Alg11
cggcgtggcccaagt

SEQ ID NO: 67393 - DNA, 15 bp, Artificial Sequence
  dgRNA
  Alg11
tgtgcgccccgcctg

SEQ ID NO: 67394 - DNA, 15 bp, Artificial Sequence
  dgRNA
  Alg11
gtgcgccccgcctgt

SEQ ID NO: 67395 - DNA, 15 bp, Artificial Sequence
  dgRNA
  Oosp1
attctaatgcaagtc

SEQ ID NO: 67396 - DNA, 15 bp, Artificial Sequence
  dgRNA
  Oosp1
ctttgagaacaatcc

SEQ ID NO: 67397 - DNA, 15 bp, Artificial Sequence
  dgRNA
  Oosp1
gttacactttagaca

SEQ ID NO: 67398 - DNA, 15 bp, Artificial Sequence
  dgRNA
  Oosp1
cacgtatttaggcac

SEQ ID NO: 67399 - DNA, 15 bp, Artificial Sequence
  dgRNA
  Pde8a
tacggtagcccgact

SEQ ID NO: 67400 - DNA, 15 bp, Artificial Sequence
  dgRNA
  Pde8a
acggtagcccgacta

SEQ ID NO: 67401 - DNA, 15 bp, Artificial Sequence
  dgRNA
  Pde8a
cggtagcccgactag

SEQ ID NO: 67402 - DNA, 15 bp, Artificial Sequence
  dgRNA
  Pde8a
cacccagccgtccgc

SEQ ID NO: 67403 - DNA, 15 bp, Artificial Sequence
  dgRNA
  Olfr1046
ggctctctgacatac

SEQ ID NO: 67404 - DNA, 15 bp, Artificial Sequence
  dgRNA
  Olfr1046
agtgtcaatctgtgc

SEQ ID NO: 67405 - DNA, 15 bp, Artificial Sequence
  dgRNA
  Exosc8
acacttgcggaagcg

SEQ ID NO: 67406 - DNA, 15 bp, Artificial Sequence
  dgRNA
  Exosc8
tgcggaagcgcggtg

SEQ ID NO: 67407 - DNA, 15 bp, Artificial Sequence
  dgRNA
  Exosc8
gcgccccgccccagc

SEQ ID NO: 67408 - DNA, 15 bp, Artificial Sequence
  dgRNA
  Exosc8
cccagccggccccgc

SEQ ID NO: 67409 - DNA, 15 bp, Artificial Sequence
  dgRNA
  Fgd2
cgtgccttctctaac

SEQ ID NO: 67410 - DNA, 15 bp, Artificial Sequence
  dgRNA
  Fgd2
ggtcagatgccaaga

SEQ ID NO: 67411 - DNA, 15 bp, Artificial Sequence
  dgRNA
  Fgd2
cgggcagtacttcac

SEQ ID NO: 67412 - DNA, 15 bp, Artificial Sequence
  dgRNA
  Fgd2
caaggagagtttgac

SEQ ID NO: 67413 - DNA, 15 bp, Artificial Sequence
  dgRNA
  Inpp1
tcacttgtgacgtcg

SEQ ID NO: 67414 - DNA, 15 bp, Artificial Sequence
  dgRNA
  Inpp1
cttgtgacgtcgcgg

SEQ ID NO: 67415 - DNA, 15 bp, Artificial Sequence
  dgRNA
  Inpp1
gcggaggccagactc

SEQ ID NO: 67416 - DNA, 15 bp, Artificial Sequence
  dgRNA
  Inpp1
cgccccagaagcaag

SEQ ID NO: 67417 - DNA, 15 bp, Artificial Sequence
  dgRNA
  Kcne2
cacccgcatctcccc

SEQ ID NO: 67418 - DNA, 15 bp, Artificial Sequence
  dgRNA
  Kcne2
ataactgtcacacag

SEQ ID NO: 67419 - DNA, 15 bp, Artificial Sequence
  dgRNA
  Kcne2
agcccgacgtcacac

SEQ ID NO: 67420 - DNA, 15 bp, Artificial Sequence
  dgRNA
  Kcne2
tgccccgccctgtca

SEQ ID NO: 67421 - DNA, 15 bp, Artificial Sequence
  dgRNA
  Ern1
aaagcccgccccgac

SEQ ID NO: 67422 - DNA, 15 bp, Artificial Sequence
  dgRNA
  Ern1
ccgaccggaagaagc

SEQ ID NO: 67423 - DNA, 15 bp, Artificial Sequence
  dgRNA
  Ern1
cgaccggaagaagcc

SEQ ID NO: 67424 - DNA, 15 bp, Artificial Sequence
  dgRNA
  Ern1
acacaaggcacttat

SEQ ID NO: 67425 - DNA, 15 bp, Artificial Sequence
  dgRNA
  Olfr1532-ps1
gtcaatcttaaaaac

SEQ ID NO: 67426 - DNA, 15 bp, Artificial Sequence
  dgRNA
  Actr3
acccggaaccggaag

SEQ ID NO: 67427 - DNA, 15 bp, Artificial Sequence
  dgRNA
  Actr3
cccggaaccggaagt

SEQ ID NO: 67428 - DNA, 15 bp, Artificial Sequence
  dgRNA
  Actr3
aagtgggagcgatcg

SEQ ID NO: 67429 - DNA, 15 bp, Artificial Sequence
  dgRNA
  Actr3
ggagcgatcgcggcc

SEQ ID NO: 67430 - DNA, 15 bp, Artificial Sequence
  dgRNA
  Itpr2
cagcgccgcccagcg

SEQ ID NO: 67431 - DNA, 15 bp, Artificial Sequence
  dgRNA
  Itpr2
tgtcctggccgcttc

SEQ ID NO: 67432 - DNA, 15 bp, Artificial Sequence
  dgRNA
  Itpr2
gtcctggccgcttcg

SEQ ID NO: 67433 - DNA, 15 bp, Artificial Sequence
  dgRNA
  Itpr2
ctggccgcttcgggg

SEQ ID NO: 67434 - DNA, 15 bp, Artificial Sequence
  dgRNA
  Stat3
cgacgtcgcggcgga

SEQ ID NO: 67435 - DNA, 15 bp, Artificial Sequence
  dgRNA
  Stat3
ggaacgagccctaac

SEQ ID NO: 67436 - DNA, 15 bp, Artificial Sequence
  dgRNA
  Stat3
tcagcgatccggtta

SEQ ID NO: 67437 - DNA, 15 bp, Artificial Sequence
  dgRNA
  Stat3
ctcagcgatccggtt

SEQ ID NO: 67438 - DNA, 15 bp, Artificial Sequence
  dgRNA
  Mis12
tccgccaatccctgc

SEQ ID NO: 67439 - DNA, 15 bp, Artificial Sequence
  dgRNA
  Mis12
ttttaccaatcgcag

SEQ ID NO: 67440 - DNA, 15 bp, Artificial Sequence
  dgRNA
  Mis12
gctccttttgaccca

SEQ ID NO: 67441 - DNA, 15 bp, Artificial Sequence
  dgRNA
  Mis12
cacggctagccaatc

SEQ ID NO: 67442 - DNA, 15 bp, Artificial Sequence
  dgRNA
  Calr3
cctgagtagctgcgt

SEQ ID NO: 67443 - DNA, 15 bp, Artificial Sequence
  dgRNA
  Calr3
tggcttcttcccgct

SEQ ID NO: 67444 - DNA, 15 bp, Artificial Sequence
  dgRNA
  Calr3
tcagcctcaaagtat

SEQ ID NO: 67445 - DNA, 15 bp, Artificial Sequence
  dgRNA
  Calr3
gtgtgcggttgcctc

SEQ ID NO: 67446 - DNA, 15 bp, Artificial Sequence
  dgRNA
  Aph1c
tgcaaaaacaagccg

SEQ ID NO: 67447 - DNA, 15 bp, Artificial Sequence
  dgRNA
  Aph1c
ccgcggagcatctca

SEQ ID NO: 67448 - DNA, 15 bp, Artificial Sequence
  dgRNA
  Aph1c
cagaaaccgccccta

SEQ ID NO: 67449 - DNA, 15 bp, Artificial Sequence
  dgRNA
  Aph1c
cgctcaaaaaagcct

SEQ ID NO: 67450 - DNA, 15 bp, Artificial Sequence
  dgRNA
  Atp2c2
gcgattcttatgctc

SEQ ID NO: 67451 - DNA, 15 bp, Artificial Sequence
  dgRNA
  Atp2c2
atgctctggcaggtt

SEQ ID NO: 67452 - DNA, 15 bp, Artificial Sequence
  dgRNA
  Atp2c2
gctgcggctgaccct

SEQ ID NO: 67453 - DNA, 15 bp, Artificial Sequence
  dgRNA
  Atp2c2
gggtcctggcgccag

SEQ ID NO: 67454 - DNA, 15 bp, Artificial Sequence
  dgRNA
  Dek
cacccagccacccgc

SEQ ID NO: 67455 - DNA, 15 bp, Artificial Sequence
  dgRNA
  Dek
ccggacgccgcgacc

SEQ ID NO: 67456 - DNA, 15 bp, Artificial Sequence
  dgRNA
  Dek
acccgggtcctcccg

SEQ ID NO: 67457 - DNA, 15 bp, Artificial Sequence
  dgRNA
  Dek
ccccgagaccccgcc

SEQ ID NO: 67458 - DNA, 15 bp, Artificial Sequence
  dgRNA
  Fam120a
ccgggagcccggccg

SEQ ID NO: 67459 - DNA, 15 bp, Artificial Sequence
  dgRNA
  Fam120a
cctcccgcgtccgcg

SEQ ID NO: 67460 - DNA, 15 bp, Artificial Sequence
  dgRNA
  Fam120a
ctcccgcgtccgcgc

SEQ ID NO: 67461 - DNA, 15 bp, Artificial Sequence
  dgRNA
  Fam120a
ccgcgtccgcgcggg

SEQ ID NO: 67462 - DNA, 15 bp, Artificial Sequence
  dgRNA
  Psat1
cccagaggtgcgcga

SEQ ID NO: 67463 - DNA, 15 bp, Artificial Sequence
  dgRNA
  Psat1
gtgcgcgaaggcaga

SEQ ID NO: 67464 - DNA, 15 bp, Artificial Sequence
  dgRNA
  Psat1
aggcacctcgccacg

SEQ ID NO: 67465 - DNA, 15 bp, Artificial Sequence
  dgRNA
  Psat1
ggcacctcgccacgc

SEQ ID NO: 67466 - DNA, 15 bp, Artificial Sequence
  dgRNA
  Ptp4a1
cgcggctctagcgac

SEQ ID NO: 67467 - DNA, 15 bp, Artificial Sequence
  dgRNA
  Ptp4a1
agcgaccggagcgtt

SEQ ID NO: 67468 - DNA, 15 bp, Artificial Sequence
  dgRNA
  Ptp4a1
gaccggagcgtttgg

SEQ ID NO: 67469 - DNA, 15 bp, Artificial Sequence
  dgRNA
  Ptp4a1
gagcgtttggtggcg

SEQ ID NO: 67470 - DNA, 15 bp, Artificial Sequence
  dgRNA
  Wash1
gttaagcacagagtg

SEQ ID NO: 67471 - DNA, 15 bp, Artificial Sequence
  dgRNA
  Wash1
gcggcttcctggtct

SEQ ID NO: 67472 - DNA, 15 bp, Artificial Sequence
  dgRNA
  Wash1
cgcccaccagcagcc

SEQ ID NO: 67473 - DNA, 15 bp, Artificial Sequence
  dgRNA
  Wash1
cggagagccggaagt

SEQ ID NO: 67474 - DNA, 15 bp, Artificial Sequence
  dgRNA
  Spata13
gcgagagcagccccg

SEQ ID NO: 67475 - DNA, 15 bp, Artificial Sequence
  dgRNA
  Spata13
cgagagcagccccgg

SEQ ID NO: 67476 - DNA, 15 bp, Artificial Sequence
  dgRNA
  Spata13
tgccggcgcgctcag

SEQ ID NO: 67477 - DNA, 15 bp, Artificial Sequence
  dgRNA
  Spata13
atccactgagcgcgc

SEQ ID NO: 67478 - DNA, 15 bp, Artificial Sequence
  dgRNA
  Fut7
gacatagggtcgggt

SEQ ID NO: 67479 - DNA, 15 bp, Artificial Sequence
  dgRNA
  Fut7
acatagggtcgggtc

SEQ ID NO: 67480 - DNA, 15 bp, Artificial Sequence
  dgRNA
  Fut7
ggcagagcgaagtgt

SEQ ID NO: 67481 - DNA, 15 bp, Artificial Sequence
  dgRNA
  Fut7
ggaagtgatccccaa

SEQ ID NO: 67482 - DNA, 15 bp, Artificial Sequence
  dgRNA
  Hif3a
gggtgtgcattacat

SEQ ID NO: 67483 - DNA, 15 bp, Artificial Sequence
  dgRNA
  Hif3a
ttccaatcagagccg

SEQ ID NO: 67484 - DNA, 15 bp, Artificial Sequence
  dgRNA
  Hif3a
tccaatcagagccgc

SEQ ID NO: 67485 - DNA, 15 bp, Artificial Sequence
  dgRNA
  Hif3a
atcagagccgcgggc

SEQ ID NO: 67486 - DNA, 15 bp, Artificial Sequence
  dgRNA
  Zfp329
cgcagctgcaggtac

SEQ ID NO: 67487 - DNA, 15 bp, Artificial Sequence
  dgRNA
  Zfp329
gcgcgtcgcaggacc

SEQ ID NO: 67488 - DNA, 15 bp, Artificial Sequence
  dgRNA
  Zfp329
caaggcattgcgatc

SEQ ID NO: 67489 - DNA, 15 bp, Artificial Sequence
  dgRNA
  Zfp329
gcgcacgcgtcctag

SEQ ID NO: 67490 - DNA, 15 bp, Artificial Sequence
  dgRNA
  Vtcn1
tgaattcaagccccg

SEQ ID NO: 67491 - DNA, 15 bp, Artificial Sequence
  dgRNA
  Vtcn1
cccgaggtagagact

SEQ ID NO: 67492 - DNA, 15 bp, Artificial Sequence
  dgRNA
  Vtcn1
accctttcacaggtc

SEQ ID NO: 67493 - DNA, 15 bp, Artificial Sequence
  dgRNA
  Vtcn1
ggtcagggcctagaa

SEQ ID NO: 67494 - DNA, 15 bp, Artificial Sequence
  dgRNA
  Olfr134
ttactatcagtaatt

SEQ ID NO: 67495 - DNA, 15 bp, Artificial Sequence
  dgRNA
  Olfr134
agtctcatgatgcat

SEQ ID NO: 67496 - DNA, 15 bp, Artificial Sequence
  dgRNA
  Klc1
cgagccgcagagggt

SEQ ID NO: 67497 - DNA, 15 bp, Artificial Sequence
  dgRNA
  Klc1
tgggtcctggccgcc

SEQ ID NO: 67498 - DNA, 15 bp, Artificial Sequence
  dgRNA
  Klc1
cccgtcctccacggg

SEQ ID NO: 67499 - DNA, 15 bp, Artificial Sequence
  dgRNA
  Klc1
gtcctccacgggtgg

SEQ ID NO: 67500 - DNA, 15 bp, Artificial Sequence
  dgRNA
  2610020H08Rik
tcgcgaatggcgacg

SEQ ID NO: 67501 - DNA, 15 bp, Artificial Sequence
  dgRNA
  2610020H08Rik
cgcgaatggcgacgt

SEQ ID NO: 67502 - DNA, 15 bp, Artificial Sequence
  dgRNA
  2610020H08Rik
gcgaatggcgacgtg

SEQ ID NO: 67503 - DNA, 15 bp, Artificial Sequence
  dgRNA
  2610020H08Rik
gggcccgagaagacc

SEQ ID NO: 67504 - DNA, 15 bp, Artificial Sequence
  dgRNA
  Zmynd15
gccccgcctcatctc

SEQ ID NO: 67505 - DNA, 15 bp, Artificial Sequence
  dgRNA
  Zmynd15
ttctgcggagcttgt

SEQ ID NO: 67506 - DNA, 15 bp, Artificial Sequence
  dgRNA
  Zmynd15
tctgcggagcttgtt

SEQ ID NO: 67507 - DNA, 15 bp, Artificial Sequence
  dgRNA
  Zmynd15
actgatgttttgcga

SEQ ID NO: 67508 - DNA, 15 bp, Artificial Sequence
  dgRNA
  Gpr141
ctagtgtgcttgaaa

SEQ ID NO: 67509 - DNA, 15 bp, Artificial Sequence
  dgRNA
  Rad21
ccgcaaacctcttca

SEQ ID NO: 67510 - DNA, 15 bp, Artificial Sequence
  dgRNA
  Rad21
tttgcgcctgctccg

SEQ ID NO: 67511 - DNA, 15 bp, Artificial Sequence
  dgRNA
  Rad21
tgctccgtggccaat

SEQ ID NO: 67512 - DNA, 15 bp, Artificial Sequence
  dgRNA
  Rad21
tccgtggccaatagg

SEQ ID NO: 67513 - DNA, 15 bp, Artificial Sequence
  dgRNA
  Nfatc2
tggcgctgagtaaac

SEQ ID NO: 67514 - DNA, 15 bp, Artificial Sequence
  dgRNA
  Nfatc2
cgctgagtaaacagg

SEQ ID NO: 67515 - DNA, 15 bp, Artificial Sequence
  dgRNA
  Nfatc2
tataaacacggagcg

SEQ ID NO: 67516 - DNA, 15 bp, Artificial Sequence
  dgRNA
  Nfatc2
ataaacacggagcgc

SEQ ID NO: 67517 - DNA, 15 bp, Artificial Sequence
  dgRNA
  Ulk3
tcccgccccctacgt

SEQ ID NO: 67518 - DNA, 15 bp, Artificial Sequence
  dgRNA
  Ulk3
cgccccctacgtagg

SEQ ID NO: 67519 - DNA, 15 bp, Artificial Sequence
  dgRNA
  Ulk3
acgtaggtggtctct

SEQ ID NO: 67520 - DNA, 15 bp, Artificial Sequence
  dgRNA
  Ulk3
ggcaatccttggcag

SEQ ID NO: 67521 - DNA, 15 bp, Artificial Sequence
  dgRNA
  Pgam1
cctaaagaggaagcg

SEQ ID NO: 67522 - DNA, 15 bp, Artificial Sequence
  dgRNA
  Pgam1
cgcggcgtgtccagt

SEQ ID NO: 67523 - DNA, 15 bp, Artificial Sequence
  dgRNA
  Pgam1
tgtccagtcggcgcc

SEQ ID NO: 67524 - DNA, 15 bp, Artificial Sequence
  dgRNA
  Pgam1
gcgctccgtgactgc

SEQ ID NO: 67525 - DNA, 15 bp, Artificial Sequence
  dgRNA
  Gfap
cccgttcctccataa

SEQ ID NO: 67526 - DNA, 15 bp, Artificial Sequence
  dgRNA
  Gfap
tatggaggaacgggt

SEQ ID NO: 67527 - DNA, 15 bp, Artificial Sequence
  dgRNA
  Dnajc5b
taatagcagactgta

SEQ ID NO: 67528 - DNA, 15 bp, Artificial Sequence
  dgRNA
  Dnajc5b
aaagggataaccaat

SEQ ID NO: 67529 - DNA, 15 bp, Artificial Sequence
  dgRNA
  Dnajc5b
aattggttatccctt

SEQ ID NO: 67530 - DNA, 15 bp, Artificial Sequence
  dgRNA
  Dnajc5b
actttatcagccaat

SEQ ID NO: 67531 - DNA, 15 bp, Artificial Sequence
  dgRNA
  Gpc3
cgccccgcatcccgc

SEQ ID NO: 67532 - DNA, 15 bp, Artificial Sequence
  dgRNA
  Gpc3
cccacgccgtcctcc

SEQ ID NO: 67533 - DNA, 15 bp, Artificial Sequence
  dgRNA
  Gpc3
ctcgccacgcccaca

SEQ ID NO: 67534 - DNA, 15 bp, Artificial Sequence
  dgRNA
  Gpc3
cacaaggctccgccc

SEQ ID NO: 67535 - DNA, 15 bp, Artificial Sequence
  dgRNA
  Sv2b
aaccttactcctcgt

SEQ ID NO: 67536 - DNA, 15 bp, Artificial Sequence
  dgRNA
  Sv2b
cgtgcccacacctgc

SEQ ID NO: 67537 - DNA, 15 bp, Artificial Sequence
  dgRNA
  Sv2b
tgagggcgccctccg

SEQ ID NO: 67538 - DNA, 15 bp, Artificial Sequence
  dgRNA
  Sv2b
gagggcgccctccgc

SEQ ID NO: 67539 - DNA, 15 bp, Artificial Sequence
  dgRNA
  Gsx2
gggcagcctatcccg

SEQ ID NO: 67540 - DNA, 15 bp, Artificial Sequence
  dgRNA
  Gsx2
ggcagcctatcccga

SEQ ID NO: 67541 - DNA, 15 bp, Artificial Sequence
  dgRNA
  Gsx2
agcctatcccgaggg

SEQ ID NO: 67542 - DNA, 15 bp, Artificial Sequence
  dgRNA
  Gsx2
gcctatcccgagggt

SEQ ID NO: 67543 - DNA, 15 bp, Artificial Sequence
  dgRNA
  Agpat5
ctcgcacgccagcac

SEQ ID NO: 67544 - DNA, 15 bp, Artificial Sequence
  dgRNA
  Agpat5
gcatgcgtcgtgacg

SEQ ID NO: 67545 - DNA, 15 bp, Artificial Sequence
  dgRNA
  Agpat5
gtcgtgacgaggcca

SEQ ID NO: 67546 - DNA, 15 bp, Artificial Sequence
  dgRNA
  Agpat5
tcgtgacgaggccaa

SEQ ID NO: 67547 - DNA, 15 bp, Artificial Sequence
  dgRNA
  Ncoa3
ttcacctccagcggc

SEQ ID NO: 67548 - DNA, 15 bp, Artificial Sequence
  dgRNA
  Ncoa3
tcacctccagcggct

SEQ ID NO: 67549 - DNA, 15 bp, Artificial Sequence
  dgRNA
  Ncoa3
cccctgcctcgcgca

SEQ ID NO: 67550 - DNA, 15 bp, Artificial Sequence
  dgRNA
  Ncoa3
tcgcgcacggccccc

SEQ ID NO: 67551 - DNA, 15 bp, Artificial Sequence
  dgRNA
  Kif17
gttgctgaacctcac

SEQ ID NO: 67552 - DNA, 15 bp, Artificial Sequence
  dgRNA
  Kif17
atagggtagttccta

SEQ ID NO: 67553 - DNA, 15 bp, Artificial Sequence
  dgRNA
  Kif17
gtagttcctacggcc

SEQ ID NO: 67554 - DNA, 15 bp, Artificial Sequence
  dgRNA
  Kif17
cgtcctgtgacgtca

SEQ ID NO: 67555 - DNA, 15 bp, Artificial Sequence
  dgRNA
  Arl3
agaccgcctgcgcaa

SEQ ID NO: 67556 - DNA, 15 bp, Artificial Sequence
  dgRNA
  Arl3
gaccgcctgcgcaat

SEQ ID NO: 67557 - DNA, 15 bp, Artificial Sequence
  dgRNA
  Arl3
cgcctgcgcaatggg

SEQ ID NO: 67558 - DNA, 15 bp, Artificial Sequence
  dgRNA
  Arl3
gcctgcgcaatgggc

SEQ ID NO: 67559 - DNA, 15 bp, Artificial Sequence
  dgRNA
  Cfap97
catgatggagttcca

SEQ ID NO: 67560 - DNA, 15 bp, Artificial Sequence
  dgRNA
  Cfap97
gtacaattatcagac

SEQ ID NO: 67561 - DNA, 15 bp, Artificial Sequence
  dgRNA
  C6
caacaactctcaatg

SEQ ID NO: 67562 - DNA, 15 bp, Artificial Sequence
  dgRNA
  C6
gtatagcagtttcta

SEQ ID NO: 67563 - DNA, 15 bp, Artificial Sequence
  dgRNA
  Camsap3
gtactctcaagcaag

SEQ ID NO: 67564 - DNA, 15 bp, Artificial Sequence
  dgRNA
  Actrt1
ccaaatgaatagtgt

SEQ ID NO: 67565 - DNA, 15 bp, Artificial Sequence
  dgRNA
  Actrt1
agaggcaatattcat

SEQ ID NO: 67566 - DNA, 15 bp, Artificial Sequence
  dgRNA
  Actrt1
ccaacactattcatt

SEQ ID NO: 67567 - DNA, 15 bp, Artificial Sequence
  dgRNA
  Actrt1
gaggtaagatggttt

SEQ ID NO: 67568 - DNA, 15 bp, Artificial Sequence
  dgRNA
  Mbd4
gtgcgcatgtacaaa

SEQ ID NO: 67569 - DNA, 15 bp, Artificial Sequence
  dgRNA
  Mbd4
tgcgcatgtacaaaa

SEQ ID NO: 67570 - DNA, 15 bp, Artificial Sequence
  dgRNA
  Mbd4
cctccgccgaagcgc

SEQ ID NO: 67571 - DNA, 15 bp, Artificial Sequence
  dgRNA
  Mbd4
ctccgccgaagcgcc

SEQ ID NO: 67572 - DNA, 15 bp, Artificial Sequence
  dgRNA
  Med28
ttagggacagcccaa

SEQ ID NO: 67573 - DNA, 15 bp, Artificial Sequence
  dgRNA
  Med28
gccagcgcccttgtt

SEQ ID NO: 67574 - DNA, 15 bp, Artificial Sequence
  dgRNA
  Med28
agagtaaacccaggt

SEQ ID NO: 67575 - DNA, 15 bp, Artificial Sequence
  dgRNA
  Med28
aggtcggctataaat

SEQ ID NO: 67576 - DNA, 15 bp, Artificial Sequence
  dgRNA
  Phyhd1
acactagtactgccc

SEQ ID NO: 67577 - DNA, 15 bp, Artificial Sequence
  dgRNA
  Phyhd1
tagtgtgtctagtgt

SEQ ID NO: 67578 - DNA, 15 bp, Artificial Sequence
  dgRNA
  Phyhd1
ctagtgtgtctagtg

SEQ ID NO: 67579 - DNA, 15 bp, Artificial Sequence
  dgRNA
  Phyhd1
tctaaaattcactcc

SEQ ID NO: 67580 - DNA, 15 bp, Artificial Sequence
  dgRNA
  Spaca1
gtctgggcttcgaat

SEQ ID NO: 67581 - DNA, 15 bp, Artificial Sequence
  dgRNA
  Spaca1
tctgggcttcgaatg

SEQ ID NO: 67582 - DNA, 15 bp, Artificial Sequence
  dgRNA
  Spaca1
gaatggggtgacgcg

SEQ ID NO: 67583 - DNA, 15 bp, Artificial Sequence
  dgRNA
  Spaca1
gcggtgacgcctcaa

SEQ ID NO: 67584 - DNA, 15 bp, Artificial Sequence
  dgRNA
  Fcgrt
tcacattcagcgtgc

SEQ ID NO: 67585 - DNA, 15 bp, Artificial Sequence
  dgRNA
  Fcgrt
cgtgcaggcctttcc

SEQ ID NO: 67586 - DNA, 15 bp, Artificial Sequence
  dgRNA
  Fcgrt
acatagaagctgttt

SEQ ID NO: 67587 - DNA, 15 bp, Artificial Sequence
  dgRNA
  Fcgrt
taatgacgtttgccc

SEQ ID NO: 67588 - DNA, 15 bp, Artificial Sequence
  dgRNA
  1-Mar
tcaagttccctaaat

SEQ ID NO: 67589 - DNA, 15 bp, Artificial Sequence
  dgRNA
  1-Mar
tagctcaatttgcct

SEQ ID NO: 67590 - DNA, 15 bp, Artificial Sequence
  dgRNA
  1-Mar
atagctcaatttgcc

SEQ ID NO: 67591 - DNA, 15 bp, Artificial Sequence
  dgRNA
  Atp5h
ctgcccgcgcgccgc

SEQ ID NO: 67592 - DNA, 15 bp, Artificial Sequence
  dgRNA
  Atp5h
tgcccgcgcgccgcc

SEQ ID NO: 67593 - DNA, 15 bp, Artificial Sequence
  dgRNA
  Atp5h
ggccggccgactcct

SEQ ID NO: 67594 - DNA, 15 bp, Artificial Sequence
  dgRNA
  Atp5h
cggccgactcctcgg

SEQ ID NO: 67595 - DNA, 15 bp, Artificial Sequence
  dgRNA
  Krt40
taaatacccatttga

SEQ ID NO: 67596 - DNA, 15 bp, Artificial Sequence
  dgRNA
  Krt40
tttatgcctcgtaaa

SEQ ID NO: 67597 - DNA, 15 bp, Artificial Sequence
  dgRNA
  Krt40
caaatgggtatttac

SEQ ID NO: 67598 - DNA, 15 bp, Artificial Sequence
  dgRNA
  Krt40
tcgcctagtctccaa

SEQ ID NO: 67599 - DNA, 15 bp, Artificial Sequence
  dgRNA
  Trim8
tcctcagcgcaggcg

SEQ ID NO: 67600 - DNA, 15 bp, Artificial Sequence
  dgRNA
  Trim8
ggcgcccgcccagtg

SEQ ID NO: 67601 - DNA, 15 bp, Artificial Sequence
  dgRNA
  Trim8
gcgcccgcccagtgc

SEQ ID NO: 67602 - DNA, 15 bp, Artificial Sequence
  dgRNA
  Trim8
cgcccgcccagtgcg

SEQ ID NO: 67603 - DNA, 15 bp, Artificial Sequence
  dgRNA
  Spem1
ccagtgtgttcaccc

SEQ ID NO: 67604 - DNA, 15 bp, Artificial Sequence
  dgRNA
  Spem1
cttagcacattatga

SEQ ID NO: 67605 - DNA, 15 bp, Artificial Sequence
  dgRNA
  Spem1
aacctcattgtgacc

SEQ ID NO: 67606 - DNA, 15 bp, Artificial Sequence
  dgRNA
  Spem1
gacccggtcactctc

SEQ ID NO: 67607 - DNA, 15 bp, Artificial Sequence
  dgRNA
  Cav2
tccccgcaggcccgg

SEQ ID NO: 67608 - DNA, 15 bp, Artificial Sequence
  dgRNA
  Cav2
ccccgcaggcccggc

SEQ ID NO: 67609 - DNA, 15 bp, Artificial Sequence
  dgRNA
  Cav2
cccgcaggcccggcg

SEQ ID NO: 67610 - DNA, 15 bp, Artificial Sequence
  dgRNA
  Cav2
gcaggcccggcgggg

SEQ ID NO: 67611 - DNA, 15 bp, Artificial Sequence
  dgRNA
  Ccdc54
ctatatgatgcattg

SEQ ID NO: 67612 - DNA, 15 bp, Artificial Sequence
  dgRNA
  Ccdc54
aactattgcctctga

SEQ ID NO: 67613 - DNA, 15 bp, Artificial Sequence
  dgRNA
  Tmem38a
gttctgacgtcccta

SEQ ID NO: 67614 - DNA, 15 bp, Artificial Sequence
  dgRNA
  Tmem38a
tacggccccgcattt

SEQ ID NO: 67615 - DNA, 15 bp, Artificial Sequence
  dgRNA
  Tmem38a
acggccccgcatttt

SEQ ID NO: 67616 - DNA, 15 bp, Artificial Sequence
  dgRNA
  Tmem38a
cgcattttgggctcc

SEQ ID NO: 67617 - DNA, 15 bp, Artificial Sequence
  dgRNA
  Intu
aaacgagtctcagcc

SEQ ID NO: 67618 - DNA, 15 bp, Artificial Sequence
  dgRNA
  Intu
gcctggctcgtcgcg

SEQ ID NO: 67619 - DNA, 15 bp, Artificial Sequence
  dgRNA
  Intu
tcgcgtggaagagcg

SEQ ID NO: 67620 - DNA, 15 bp, Artificial Sequence
  dgRNA
  Intu
cgcgtggaagagcgt

SEQ ID NO: 67621 - DNA, 15 bp, Artificial Sequence
  dgRNA
  Abhd10
atgcgtctccgcgcc

SEQ ID NO: 67622 - DNA, 15 bp, Artificial Sequence
  dgRNA
  Abhd10
tgcgtctccgcgccc

SEQ ID NO: 67623 - DNA, 15 bp, Artificial Sequence
  dgRNA
  Abhd10
gcgtctccgcgcccg

SEQ ID NO: 67624 - DNA, 15 bp, Artificial Sequence
  dgRNA
  Abhd10
cgtctccgcgcccgg

SEQ ID NO: 67625 - DNA, 15 bp, Artificial Sequence
  dgRNA
  Mettl7b
gcaaagtcctatccg

SEQ ID NO: 67626 - DNA, 15 bp, Artificial Sequence
  dgRNA
  Mettl7b
aagtcctatccgagg

SEQ ID NO: 67627 - DNA, 15 bp, Artificial Sequence
  dgRNA
  Mettl7b
tcctatccgaggagg

SEQ ID NO: 67628 - DNA, 15 bp, Artificial Sequence
  dgRNA
  Mettl7b
cctatccgaggagga

SEQ ID NO: 67629 - DNA, 15 bp, Artificial Sequence
  dgRNA
  Slc22a23
cgggcggtggcgaca

SEQ ID NO: 67630 - DNA, 15 bp, Artificial Sequence
  dgRNA
  Slc22a23
ggtggcgacacggcc

SEQ ID NO: 67631 - DNA, 15 bp, Artificial Sequence
  dgRNA
  Slc22a23
gcgacacggcccggc

SEQ ID NO: 67632 - DNA, 15 bp, Artificial Sequence
  dgRNA
  Slc22a23
cacggcccggctgga

SEQ ID NO: 67633 - DNA, 15 bp, Artificial Sequence
  dgRNA
  4933402N03Rik
gcctgtttcactcca

SEQ ID NO: 67634 - DNA, 15 bp, Artificial Sequence
  dgRNA
  4933402N03Rik
gggttagatgaccct

SEQ ID NO: 67635 - DNA, 15 bp, Artificial Sequence
  dgRNA
  4933402N03Rik
gaagtctgcacctaa

SEQ ID NO: 67636 - DNA, 15 bp, Artificial Sequence
  dgRNA
  4933402N03Rik
tgaagtctgcaccta

SEQ ID NO: 67637 - DNA, 15 bp, Artificial Sequence
  dgRNA
  Rp1l1
tcaaatagggacccc

SEQ ID NO: 67638 - DNA, 15 bp, Artificial Sequence
  dgRNA
  Rp1l1
cctcctctcaggccg

SEQ ID NO: 67639 - DNA, 15 bp, Artificial Sequence
  dgRNA
  Rp1l1
ctcctctcaggccga

SEQ ID NO: 67640 - DNA, 15 bp, Artificial Sequence
  dgRNA
  Rp1l1
ccccactaatcctct

SEQ ID NO: 67641 - DNA, 15 bp, Artificial Sequence
  dgRNA
  Abl2
tcggtggtttaaaga

SEQ ID NO: 67642 - DNA, 15 bp, Artificial Sequence
  dgRNA
  Abl2
atggcggcggcggct

SEQ ID NO: 67643 - DNA, 15 bp, Artificial Sequence
  dgRNA
  Abl2
ggggcgaggagccgc

SEQ ID NO: 67644 - DNA, 15 bp, Artificial Sequence
  dgRNA
  Abl2
gcgaggagccgccgg

SEQ ID NO: 67645 - DNA, 15 bp, Artificial Sequence
  dgRNA
  Tusc1
aaggctttccgggca

SEQ ID NO: 67646 - DNA, 15 bp, Artificial Sequence
  dgRNA
  Tusc1
tccgggcacggacac

SEQ ID NO: 67647 - DNA, 15 bp, Artificial Sequence
  dgRNA
  Tusc1
ccgggcacggacaca

SEQ ID NO: 67648 - DNA, 15 bp, Artificial Sequence
  dgRNA
  Tusc1
agcagagcgctcccc

SEQ ID NO: 67649 - DNA, 15 bp, Artificial Sequence
  dgRNA
  Apol10b
tccctgataaccagc

SEQ ID NO: 67650 - DNA, 15 bp, Artificial Sequence
  dgRNA
  Apol10b
gatcatggacagcta

SEQ ID NO: 67651 - DNA, 15 bp, Artificial Sequence
  dgRNA
  Apol10b
cgagagccccgtaaa

SEQ ID NO: 67652 - DNA, 15 bp, Artificial Sequence
  dgRNA
  Apol10b
aactggttttaggat

SEQ ID NO: 67653 - DNA, 15 bp, Artificial Sequence
  dgRNA
  Dnajb6
gctttagagccctcc

SEQ ID NO: 67654 - DNA, 15 bp, Artificial Sequence
  dgRNA
  Glrx
tctctgctaccctag

SEQ ID NO: 67655 - DNA, 15 bp, Artificial Sequence
  dgRNA
  Glrx
ctctgctaccctaga

SEQ ID NO: 67656 - DNA, 15 bp, Artificial Sequence
  dgRNA
  Glrx
gaccagtttctgggt

SEQ ID NO: 67657 - DNA, 15 bp, Artificial Sequence
  dgRNA
  Glrx
gcgcagaccagtttc

SEQ ID NO: 67658 - DNA, 15 bp, Artificial Sequence
  dgRNA
  Slc16a14
gcgataaacttcaac

SEQ ID NO: 67659 - DNA, 15 bp, Artificial Sequence
  dgRNA
  Slc16a14
agaattagccggtat

SEQ ID NO: 67660 - DNA, 15 bp, Artificial Sequence
  dgRNA
  Slc16a14
aggaatataccaacg

SEQ ID NO: 67661 - DNA, 15 bp, Artificial Sequence
  dgRNA
  Slc16a14
tgaaattgcacggat

SEQ ID NO: 67662 - DNA, 15 bp, Artificial Sequence
  dgRNA
  Emc9
cagagagtactgcgg

SEQ ID NO: 67663 - DNA, 15 bp, Artificial Sequence
  dgRNA
  Emc9
agagtactgcggagg

SEQ ID NO: 67664 - DNA, 15 bp, Artificial Sequence
  dgRNA
  Emc9
gagtactgcggaggc

SEQ ID NO: 67665 - DNA, 15 bp, Artificial Sequence
  dgRNA
  Emc9
cggaggcgggactct

SEQ ID NO: 67666 - DNA, 15 bp, Artificial Sequence
  dgRNA
  Fgf13
ggcggcgaagttgca

SEQ ID NO: 67667 - DNA, 15 bp, Artificial Sequence
  dgRNA
  Fgf13
agttgcaaggactag

SEQ ID NO: 67668 - DNA, 15 bp, Artificial Sequence
  dgRNA
  Fgf13
gactagtggaagcgc

SEQ ID NO: 67669 - DNA, 15 bp, Artificial Sequence
  dgRNA
  Fgf13
tagtggaagcgccgg

SEQ ID NO: 67670 - DNA, 15 bp, Artificial Sequence
  dgRNA
  Satb1
agcccatcagtttga

SEQ ID NO: 67671 - DNA, 15 bp, Artificial Sequence
  dgRNA
  Satb1
cccgcatgcccctac

SEQ ID NO: 67672 - DNA, 15 bp, Artificial Sequence
  dgRNA
  Satb1
ccgcatgcccctact

SEQ ID NO: 67673 - DNA, 15 bp, Artificial Sequence
  dgRNA
  Satb1
cgcatgcccctactg

SEQ ID NO: 67674 - DNA, 15 bp, Artificial Sequence
  dgRNA
  BC021891
aggggttaaagaacc

SEQ ID NO: 67675 - DNA, 15 bp, Artificial Sequence
  dgRNA
  BC021891
ggttaaagaacctgg

SEQ ID NO: 67676 - DNA, 15 bp, Artificial Sequence
  dgRNA
  BC021891
ggcgggactggcact

SEQ ID NO: 67677 - DNA, 15 bp, Artificial Sequence
  dgRNA
  BC021891
gcgggactggcacta

SEQ ID NO: 67678 - DNA, 15 bp, Artificial Sequence
  dgRNA
  Dach2
gtcccacacggcttc

SEQ ID NO: 67679 - DNA, 15 bp, Artificial Sequence
  dgRNA
  Dach2
cacacggcttcaggt

SEQ ID NO: 67680 - DNA, 15 bp, Artificial Sequence
  dgRNA
  Dach2
gtctccacccctagc

SEQ ID NO: 67681 - DNA, 15 bp, Artificial Sequence
  dgRNA
  Dach2
gcggcagccattctg

SEQ ID NO: 67682 - DNA, 15 bp, Artificial Sequence
  dgRNA
  Hnrnpa2b1
gcggagacgcgttag

SEQ ID NO: 67683 - DNA, 15 bp, Artificial Sequence
  dgRNA
  Hnrnpa2b1
cggagacgcgttagt

SEQ ID NO: 67684 - DNA, 15 bp, Artificial Sequence
  dgRNA
  Hnrnpa2b1
ggagacgcgttagtg

SEQ ID NO: 67685 - DNA, 15 bp, Artificial Sequence
  dgRNA
  Hnrnpa2b1
gagacgcgttagtgg

SEQ ID NO: 67686 - DNA, 15 bp, Artificial Sequence
  dgRNA
  Igfbp3
tcgttcccgcttcgt

SEQ ID NO: 67687 - DNA, 15 bp, Artificial Sequence
  dgRNA
  Igfbp3
cgttcccgcttcgtc

SEQ ID NO: 67688 - DNA, 15 bp, Artificial Sequence
  dgRNA
  Igfbp3
tcccgcttcgtcggg

SEQ ID NO: 67689 - DNA, 15 bp, Artificial Sequence
  dgRNA
  Igfbp3
cttcgtcgggaggcg

SEQ ID NO: 67690 - DNA, 15 bp, Artificial Sequence
  dgRNA
  Dhx58
gagcttaaggcctgg

SEQ ID NO: 67691 - DNA, 15 bp, Artificial Sequence
  dgRNA
  Dhx58
taaccctgtccatct

SEQ ID NO: 67692 - DNA, 15 bp, Artificial Sequence
  dgRNA
  Dhx58
gtaaccctgtccatc

SEQ ID NO: 67693 - DNA, 15 bp, Artificial Sequence
  dgRNA
  Stag2
tgggccgcgggttcg

SEQ ID NO: 67694 - DNA, 15 bp, Artificial Sequence
  dgRNA
  Stag2
ttcgcggccgacaga

SEQ ID NO: 67695 - DNA, 15 bp, Artificial Sequence
  dgRNA
  Stag2
ggcgggctgccattg

SEQ ID NO: 67696 - DNA, 15 bp, Artificial Sequence
  dgRNA
  Stag2
gcatctagcggcggc

SEQ ID NO: 67697 - DNA, 15 bp, Artificial Sequence
  dgRNA
  Bloc1s1
ctgtcgggttttgag

SEQ ID NO: 67698 - DNA, 15 bp, Artificial Sequence
  dgRNA
  Bloc1s1
agctgttcgctaatg

SEQ ID NO: 67699 - DNA, 15 bp, Artificial Sequence
  dgRNA
  Bloc1s1
tggtggttggtattg

SEQ ID NO: 67700 - DNA, 15 bp, Artificial Sequence
  dgRNA
  Plekha7
ggacaagatctgagg

SEQ ID NO: 67701 - DNA, 15 bp, Artificial Sequence
  dgRNA
  Plekha7
cgagaaacggggagc

SEQ ID NO: 67702 - DNA, 15 bp, Artificial Sequence
  dgRNA
  Plekha7
gagggacgagaaacg

SEQ ID NO: 67703 - DNA, 15 bp, Artificial Sequence
  dgRNA
  Plekha7
aggggtgcaagttgt

SEQ ID NO: 67704 - DNA, 15 bp, Artificial Sequence
  dgRNA
  Slc22a14
tgccttaactaattc

SEQ ID NO: 67705 - DNA, 15 bp, Artificial Sequence
  dgRNA
  Slc22a14
gtaaacggctatgtg

SEQ ID NO: 67706 - DNA, 15 bp, Artificial Sequence
  dgRNA
  Slc22a14
gaccagaattagtta

SEQ ID NO: 67707 - DNA, 15 bp, Artificial Sequence
  dgRNA
  Slc22a14
gacggtgtcacaatg

SEQ ID NO: 67708 - DNA, 15 bp, Artificial Sequence
  dgRNA
  Pnliprp2
gagccggaaggtccc

SEQ ID NO: 67709 - DNA, 15 bp, Artificial Sequence
  dgRNA
  Pnliprp2
agccggaaggtccca

SEQ ID NO: 67710 - DNA, 15 bp, Artificial Sequence
  dgRNA
  Pnliprp2
cggaaggtcccaggg

SEQ ID NO: 67711 - DNA, 15 bp, Artificial Sequence
  dgRNA
  Pnliprp2
acgatcattaaactc

SEQ ID NO: 67712 - DNA, 15 bp, Artificial Sequence
  dgRNA
  Trp53rkb
gttgccgagcgcaca

SEQ ID NO: 67713 - DNA, 15 bp, Artificial Sequence
  dgRNA
  Trp53rkb
aggaaccaagtctac

SEQ ID NO: 67714 - DNA, 15 bp, Artificial Sequence
  dgRNA
  Trp53rkb
gtctacaggtccgag

SEQ ID NO: 67715 - DNA, 15 bp, Artificial Sequence
  dgRNA
  Trp53rkb
cggaaccacactagc

SEQ ID NO: 67716 - DNA, 15 bp, Artificial Sequence
  dgRNA
  Ms4a4b
tccacccatatatga

SEQ ID NO: 67717 - DNA, 15 bp, Artificial Sequence
  dgRNA
  Ms4a4b
tgcctcttagtcagt

SEQ ID NO: 67718 - DNA, 15 bp, Artificial Sequence
  dgRNA
  Ms4a4b
gcctcttagtcagtg

SEQ ID NO: 67719 - DNA, 15 bp, Artificial Sequence
  dgRNA
  Ms4a4b
ctcttagtcagtggg

SEQ ID NO: 67720 - DNA, 15 bp, Artificial Sequence
  dgRNA
  St7l
aggtagcccctcagt

SEQ ID NO: 67721 - DNA, 15 bp, Artificial Sequence
  dgRNA
  St7l
gtccgccactatccc

SEQ ID NO: 67722 - DNA, 15 bp, Artificial Sequence
  dgRNA
  St7l
caggattcccgactc

SEQ ID NO: 67723 - DNA, 15 bp, Artificial Sequence
  dgRNA
  St7l
aggattcccgactcc

SEQ ID NO: 67724 - DNA, 15 bp, Artificial Sequence
  dgRNA
  Camkk2
gcgcgagccgaagcc

SEQ ID NO: 67725 - DNA, 15 bp, Artificial Sequence
  dgRNA
  Camkk2
cgcgagccgaagccc

SEQ ID NO: 67726 - DNA, 15 bp, Artificial Sequence
  dgRNA
  Camkk2
gggcggctcctcccg

SEQ ID NO: 67727 - DNA, 15 bp, Artificial Sequence
  dgRNA
  Camkk2
gcgcggcggcgcctc

SEQ ID NO: 67728 - DNA, 15 bp, Artificial Sequence
  dgRNA
  Vmn1r189
taacctagagggtac

SEQ ID NO: 67729 - DNA, 15 bp, Artificial Sequence
  dgRNA
  Ncr1
tttagatccaaaatg

SEQ ID NO: 67730 - DNA, 15 bp, Artificial Sequence
  dgRNA
  Ncr1
ctaggtcaatggtaa

SEQ ID NO: 67731 - DNA, 15 bp, Artificial Sequence
  dgRNA
  Ncr1
atggtgactagtgtc

SEQ ID NO: 67732 - DNA, 15 bp, Artificial Sequence
  dgRNA
  Ncr1
tggattgagtccagt

SEQ ID NO: 67733 - DNA, 15 bp, Artificial Sequence
  dgRNA
  Olfr1143
ttgttgatatccaga

SEQ ID NO: 67734 - DNA, 15 bp, Artificial Sequence
  dgRNA
  Olfr1143
ataggtattgccttc

SEQ ID NO: 67735 - DNA, 15 bp, Artificial Sequence
  dgRNA
  Kdm6a
accggctgctcccac

SEQ ID NO: 67736 - DNA, 15 bp, Artificial Sequence
  dgRNA
  Kdm6a
ccggctgctcccact

SEQ ID NO: 67737 - DNA, 15 bp, Artificial Sequence
  dgRNA
  Kdm6a
gtgacaaccctactc

SEQ ID NO: 67738 - DNA, 15 bp, Artificial Sequence
  dgRNA
  Kdm6a
accaccgaccagaac

SEQ ID NO: 67739 - DNA, 15 bp, Artificial Sequence
  dgRNA
  Riok3
cggaagcgcagagac

SEQ ID NO: 67740 - DNA, 15 bp, Artificial Sequence
  dgRNA
  Riok3
gaagtacagccctcc

SEQ ID NO: 67741 - DNA, 15 bp, Artificial Sequence
  dgRNA
  Riok3
agatccttagtatac

SEQ ID NO: 67742 - DNA, 15 bp, Artificial Sequence
  dgRNA
  Riok3
gatccttagtataca

SEQ ID NO: 67743 - DNA, 15 bp, Artificial Sequence
  dgRNA
  Slc35e3
cgcctcccagtaagt

SEQ ID NO: 67744 - DNA, 15 bp, Artificial Sequence
  dgRNA
  Slc35e3
gcctcccagtaagtc

SEQ ID NO: 67745 - DNA, 15 bp, Artificial Sequence
  dgRNA
  Slc35e3
cctcccagtaagtcg

SEQ ID NO: 67746 - DNA, 15 bp, Artificial Sequence
  dgRNA
  Slc35e3
agtaagtcggggaat

SEQ ID NO: 67747 - DNA, 15 bp, Artificial Sequence
  dgRNA
  Rbm5
caaaaaaattaacgc

SEQ ID NO: 67748 - DNA, 15 bp, Artificial Sequence
  dgRNA
  Rbm5
gcagggtatagtgac

SEQ ID NO: 67749 - DNA, 15 bp, Artificial Sequence
  dgRNA
  Rbm5
ggcgaccacacttcc

SEQ ID NO: 67750 - DNA, 15 bp, Artificial Sequence
  dgRNA
  Rbm5
agccctcgcgcagac

SEQ ID NO: 67751 - DNA, 15 bp, Artificial Sequence
  dgRNA
  Scgb1b27
aatgctaatgggacc

SEQ ID NO: 67752 - DNA, 15 bp, Artificial Sequence
  dgRNA
  Tmod3
cagagggtcacgggc

SEQ ID NO: 67753 - DNA, 15 bp, Artificial Sequence
  dgRNA
  Tmod3
ggcaggtacatatac

SEQ ID NO: 67754 - DNA, 15 bp, Artificial Sequence
  dgRNA
  Tmod3
cccttcccattgtaa

SEQ ID NO: 67755 - DNA, 15 bp, Artificial Sequence
  dgRNA
  Tmod3
ccaggtccgtatgta

SEQ ID NO: 67756 - DNA, 15 bp, Artificial Sequence
  dgRNA
  Gemin4
ggggcgagagctgcc

SEQ ID NO: 67757 - DNA, 15 bp, Artificial Sequence
  dgRNA
  Gemin4
gggcgagagctgccc

SEQ ID NO: 67758 - DNA, 15 bp, Artificial Sequence
  dgRNA
  Gemin4
ggcgagagctgcccg

SEQ ID NO: 67759 - DNA, 15 bp, Artificial Sequence
  dgRNA
  Gemin4
cggggttcctgagtg

SEQ ID NO: 67760 - DNA, 15 bp, Artificial Sequence
  dgRNA
  Spag6l
ggcgggtgcaacaac

SEQ ID NO: 67761 - DNA, 15 bp, Artificial Sequence
  dgRNA
  Spag6l
gcaacaaccggcaag

SEQ ID NO: 67762 - DNA, 15 bp, Artificial Sequence
  dgRNA
  Spag6l
cgtcacgacctttgc

SEQ ID NO: 67763 - DNA, 15 bp, Artificial Sequence
  dgRNA
  Spag6l
gtatccggttgctgt

SEQ ID NO: 67764 - DNA, 15 bp, Artificial Sequence
  dgRNA
  Eif2a
ggcagccgccgatcg

SEQ ID NO: 67765 - DNA, 15 bp, Artificial Sequence
  dgRNA
  Eif2a
agccgccgatcgcgg

SEQ ID NO: 67766 - DNA, 15 bp, Artificial Sequence
  dgRNA
  Eif2a
tttggggcggcgtgc

SEQ ID NO: 67767 - DNA, 15 bp, Artificial Sequence
  dgRNA
  Eif2a
ttggggcggcgtgcc

SEQ ID NO: 67768 - DNA, 15 bp, Artificial Sequence
  dgRNA
  Tmie
ccgcagctgagctcg

SEQ ID NO: 67769 - DNA, 15 bp, Artificial Sequence
  dgRNA
  Tmie
cgcagctgagctcgt

SEQ ID NO: 67770 - DNA, 15 bp, Artificial Sequence
  dgRNA
  Tmie
gcagctgagctcgtg

SEQ ID NO: 67771 - DNA, 15 bp, Artificial Sequence
  dgRNA
  Tmie
ctgcgctttgcgccg

SEQ ID NO: 67772 - DNA, 15 bp, Artificial Sequence
  dgRNA
  Olfr521
ataggttgaaggatc

SEQ ID NO: 67773 - DNA, 15 bp, Artificial Sequence
  dgRNA
  Olfr521
atctagatcagacaa

SEQ ID NO: 67774 - DNA, 15 bp, Artificial Sequence
  dgRNA
  Olfr521
tcctgagcatcgggc

SEQ ID NO: 67775 - DNA, 15 bp, Artificial Sequence
  dgRNA
  Olfr521
ccaatctgtaatcag

SEQ ID NO: 67776 - DNA, 15 bp, Artificial Sequence
  dgRNA
  Birc6
ctgaggcccgcctac

SEQ ID NO: 67777 - DNA, 15 bp, Artificial Sequence
  dgRNA
  Birc6
tgaggcccgcctacc

SEQ ID NO: 67778 - DNA, 15 bp, Artificial Sequence
  dgRNA
  Birc6
ccgcctaccgggccc

SEQ ID NO: 67779 - DNA, 15 bp, Artificial Sequence
  dgRNA
  Birc6
cgcctaccgggccct

SEQ ID NO: 67780 - DNA, 15 bp, Artificial Sequence
  dgRNA
  Nt5c2
ccttcagggcgcgct

SEQ ID NO: 67781 - DNA, 15 bp, Artificial Sequence
  dgRNA
  Nt5c2
gcgccttcgcgcccg

SEQ ID NO: 67782 - DNA, 15 bp, Artificial Sequence
  dgRNA
  Nt5c2
ccatcgcgctccagc

SEQ ID NO: 67783 - DNA, 15 bp, Artificial Sequence
  dgRNA
  Nt5c2
catcgcgctccagca

SEQ ID NO: 67784 - DNA, 15 bp, Artificial Sequence
  dgRNA
  Ptprq
ttaggagtttcgtgc

SEQ ID NO: 67785 - DNA, 15 bp, Artificial Sequence
  dgRNA
  Myo1c
cccggccactcccgc

SEQ ID NO: 67786 - DNA, 15 bp, Artificial Sequence
  dgRNA
  Myo1c
gggttccggagaaac

SEQ ID NO: 67787 - DNA, 15 bp, Artificial Sequence
  dgRNA
  Myo1c
tcgcccccgtagcct

SEQ ID NO: 67788 - DNA, 15 bp, Artificial Sequence
  dgRNA
  Myo1c
gtagcctaggcgcgc

SEQ ID NO: 67789 - DNA, 15 bp, Artificial Sequence
  dgRNA
  Cwh43
gtctatgcagcacag

SEQ ID NO: 67790 - DNA, 15 bp, Artificial Sequence
  dgRNA
  Cwh43
ggatgaacccaaagt

SEQ ID NO: 67791 - DNA, 15 bp, Artificial Sequence
  dgRNA
  Cwh43
gatgaacccaaagtc

SEQ ID NO: 67792 - DNA, 15 bp, Artificial Sequence
  dgRNA
  Cwh43
agtcgggtgcatttg

SEQ ID NO: 67793 - DNA, 15 bp, Artificial Sequence
  dgRNA
  Pmch
cacgaaataaacaac

SEQ ID NO: 67794 - DNA, 15 bp, Artificial Sequence
  dgRNA
  Pmch
ttcgcagctttacaa

SEQ ID NO: 67795 - DNA, 15 bp, Artificial Sequence
  dgRNA
  Pmch
ttacaaaggctctac

SEQ ID NO: 67796 - DNA, 15 bp, Artificial Sequence
  dgRNA
  Pmch
tacaaaggctctacg

SEQ ID NO: 67797 - DNA, 15 bp, Artificial Sequence
  dgRNA
  Fam178b
ctccgcatccgcatc

SEQ ID NO: 67798 - DNA, 15 bp, Artificial Sequence
  dgRNA
  Fam178b
gaagctgagtggcgc

SEQ ID NO: 67799 - DNA, 15 bp, Artificial Sequence
  dgRNA
  Fam178b
aagctgagtggcgcg

SEQ ID NO: 67800 - DNA, 15 bp, Artificial Sequence
  dgRNA
  Fam178b
tggcgcggggtgatc

SEQ ID NO: 67801 - DNA, 15 bp, Artificial Sequence
  dgRNA
  Figla
acccacctcgcactc

SEQ ID NO: 67802 - DNA, 15 bp, Artificial Sequence
  dgRNA
  Figla
taagctccttgcgca

SEQ ID NO: 67803 - DNA, 15 bp, Artificial Sequence
  dgRNA
  Figla
aagctccttgcgcat

SEQ ID NO: 67804 - DNA, 15 bp, Artificial Sequence
  dgRNA
  Figla
cgaggtgggttgcgg

SEQ ID NO: 67805 - DNA, 15 bp, Artificial Sequence
  dgRNA
  Taf8
aacgccacgtgagct

SEQ ID NO: 67806 - DNA, 15 bp, Artificial Sequence
  dgRNA
  Taf8
acgccacgtgagctt

SEQ ID NO: 67807 - DNA, 15 bp, Artificial Sequence
  dgRNA
  Taf8
gcttttctataaggc

SEQ ID NO: 67808 - DNA, 15 bp, Artificial Sequence
  dgRNA
  Taf8
cttttctataaggcg

SEQ ID NO: 67809 - DNA, 15 bp, Artificial Sequence
  dgRNA
  Lzts1
cactatgatgattgc

SEQ ID NO: 67810 - DNA, 15 bp, Artificial Sequence
  dgRNA
  Lzts1
agcaaaatgtagtcc

SEQ ID NO: 67811 - DNA, 15 bp, Artificial Sequence
  dgRNA
  Lzts1
ccttcagggtacaag

SEQ ID NO: 67812 - DNA, 15 bp, Artificial Sequence
  dgRNA
  Lzts1
gtgacacggaaccaa

SEQ ID NO: 67813 - DNA, 15 bp, Artificial Sequence
  dgRNA
  Mmp1b
tcctggatttaatcc

SEQ ID NO: 67814 - DNA, 15 bp, Artificial Sequence
  dgRNA
  Mmp1b
ttctctacattgaag

SEQ ID NO: 67815 - DNA, 15 bp, Artificial Sequence
  dgRNA
  Mmp1b
gagtcatatagcctc

SEQ ID NO: 67816 - DNA, 15 bp, Artificial Sequence
  dgRNA
  Mmp1b
accaggattaaatcc

SEQ ID NO: 67817 - DNA, 15 bp, Artificial Sequence
  dgRNA
  Tcaf1
gatgagacctcctct

SEQ ID NO: 67818 - DNA, 15 bp, Artificial Sequence
  dgRNA
  Tcaf1
tgagacctcctctag

SEQ ID NO: 67819 - DNA, 15 bp, Artificial Sequence
  dgRNA
  Tcaf1
agaagcgctgtctat

SEQ ID NO: 67820 - DNA, 15 bp, Artificial Sequence
  dgRNA
  Tcaf1
gcaagcgccgcccct

SEQ ID NO: 67821 - DNA, 15 bp, Artificial Sequence
  dgRNA
  Myo5b
cgccccaggacccgg

SEQ ID NO: 67822 - DNA, 15 bp, Artificial Sequence
  dgRNA
  Myo5b
aggacccggtggcgg

SEQ ID NO: 67823 - DNA, 15 bp, Artificial Sequence
  dgRNA
  Myo5b
ggacccggtggcggc

SEQ ID NO: 67824 - DNA, 15 bp, Artificial Sequence
  dgRNA
  Myo5b
gacccggtggcggcg

SEQ ID NO: 67825 - DNA, 15 bp, Artificial Sequence
  dgRNA
  Sat1
tttaggaaggttacc

SEQ ID NO: 67826 - DNA, 15 bp, Artificial Sequence
  dgRNA
  Sat1
taggaaggttaccag

SEQ ID NO: 67827 - DNA, 15 bp, Artificial Sequence
  dgRNA
  Sat1
gcattcatatgcttc

SEQ ID NO: 67828 - DNA, 15 bp, Artificial Sequence
  dgRNA
  Sat1
catatgcttccggca

SEQ ID NO: 67829 - DNA, 15 bp, Artificial Sequence
  dgRNA
  Kcne3
tctctgcacgcctac

SEQ ID NO: 67830 - DNA, 15 bp, Artificial Sequence
  dgRNA
  Nr0b1
ccctttgagctttcg

SEQ ID NO: 67831 - DNA, 15 bp, Artificial Sequence
  dgRNA
  Nr0b1
gcgcccttgtccaag

SEQ ID NO: 67832 - DNA, 15 bp, Artificial Sequence
  dgRNA
  Nr0b1
cccttgtccaagagg

SEQ ID NO: 67833 - DNA, 15 bp, Artificial Sequence
  dgRNA
  Nr0b1
cctcgaaagctcaaa

SEQ ID NO: 67834 - DNA, 15 bp, Artificial Sequence
  dgRNA
  Ptp4a2
ccgccgaggtgactg

SEQ ID NO: 67835 - DNA, 15 bp, Artificial Sequence
  dgRNA
  Ptp4a2
cgctcccgcctccgc

SEQ ID NO: 67836 - DNA, 15 bp, Artificial Sequence
  dgRNA
  Ptp4a2
tgagtgcgcccctcc

SEQ ID NO: 67837 - DNA, 15 bp, Artificial Sequence
  dgRNA
  Ptp4a2
tgcgcccctcccggg

SEQ ID NO: 67838 - DNA, 15 bp, Artificial Sequence
  dgRNA
  Ifi44
gctgccagcgtgagt

SEQ ID NO: 67839 - DNA, 15 bp, Artificial Sequence
  dgRNA
  Ifi44
gtccaagagtgtgtc

SEQ ID NO: 67840 - DNA, 15 bp, Artificial Sequence
  dgRNA
  Ifi44
cgagccaacttcagt

SEQ ID NO: 67841 - DNA, 15 bp, Artificial Sequence
  dgRNA
  Ifi44
tatacctactcacgc

SEQ ID NO: 67842 - DNA, 15 bp, Artificial Sequence
  dgRNA
  Amz2
agaggtcacgccttc

SEQ ID NO: 67843 - DNA, 15 bp, Artificial Sequence
  dgRNA
  Amz2
gaggtcacgccttcg

SEQ ID NO: 67844 - DNA, 15 bp, Artificial Sequence
  dgRNA
  Amz2
gtcacgccttcgggg

SEQ ID NO: 67845 - DNA, 15 bp, Artificial Sequence
  dgRNA
  Amz2
tcacgccttcggggc

SEQ ID NO: 67846 - DNA, 15 bp, Artificial Sequence
  dgRNA
  Ankrd34b
acgtggacgcagacc

SEQ ID NO: 67847 - DNA, 15 bp, Artificial Sequence
  dgRNA
  Ankrd34b
cgcagacccggacca

SEQ ID NO: 67848 - DNA, 15 bp, Artificial Sequence
  dgRNA
  Ankrd34b
gcagacccggaccaa

SEQ ID NO: 67849 - DNA, 15 bp, Artificial Sequence
  dgRNA
  Ankrd34b
cccggaccaagggca

SEQ ID NO: 67850 - DNA, 15 bp, Artificial Sequence
  dgRNA
  Ano8
tagatccaagtgggc

SEQ ID NO: 67851 - DNA, 15 bp, Artificial Sequence
  dgRNA
  Ano8
ggaaaaacactcggg

SEQ ID NO: 67852 - DNA, 15 bp, Artificial Sequence
  dgRNA
  Ano8
gaaaaacactcgggc

SEQ ID NO: 67853 - DNA, 15 bp, Artificial Sequence
  dgRNA
  Ano8
aaaaacactcgggcg

SEQ ID NO: 67854 - DNA, 15 bp, Artificial Sequence
  dgRNA
  Ntsr1
ccgtcagccagtatc

SEQ ID NO: 67855 - DNA, 15 bp, Artificial Sequence
  dgRNA
  Ntsr1
cgtcagccagtatcc

SEQ ID NO: 67856 - DNA, 15 bp, Artificial Sequence
  dgRNA
  Ntsr1
gccagtatccgggtg

SEQ ID NO: 67857 - DNA, 15 bp, Artificial Sequence
  dgRNA
  Ntsr1
agtatccgggtgggg

SEQ ID NO: 67858 - DNA, 15 bp, Artificial Sequence
  dgRNA
  Mtmr6
acatgtgggttagct

SEQ ID NO: 67859 - DNA, 15 bp, Artificial Sequence
  dgRNA
  Mtmr6
ttagcttggttggcc

SEQ ID NO: 67860 - DNA, 15 bp, Artificial Sequence
  dgRNA
  Mtmr6
tagcttggttggccg

SEQ ID NO: 67861 - DNA, 15 bp, Artificial Sequence
  dgRNA
  Mtmr6
agggcgctgtacaac

SEQ ID NO: 67862 - DNA, 15 bp, Artificial Sequence
  dgRNA
  Nfatc1
gaccgcgcggtcctg

SEQ ID NO: 67863 - DNA, 15 bp, Artificial Sequence
  dgRNA
  Nfatc1
accgcgcggtcctgc

SEQ ID NO: 67864 - DNA, 15 bp, Artificial Sequence
  dgRNA
  Nfatc1
tcctgcgggcacgag

SEQ ID NO: 67865 - DNA, 15 bp, Artificial Sequence
  dgRNA
  Nfatc1
ggcacgagtggagcc

SEQ ID NO: 67866 - DNA, 15 bp, Artificial Sequence
  dgRNA
  Tsc22d1
ctcctcctctcgcgc

SEQ ID NO: 67867 - DNA, 15 bp, Artificial Sequence
  dgRNA
  Tsc22d1
tcctcctctcgcgct

SEQ ID NO: 67868 - DNA, 15 bp, Artificial Sequence
  dgRNA
  Tsc22d1
cctcctctcgcgctg

SEQ ID NO: 67869 - DNA, 15 bp, Artificial Sequence
  dgRNA
  Tsc22d1
ctcgcgctggggcgc

SEQ ID NO: 67870 - DNA, 15 bp, Artificial Sequence
  dgRNA
  Sstr4
atagcccggcgaaac

SEQ ID NO: 67871 - DNA, 15 bp, Artificial Sequence
  dgRNA
  Sstr4
gcgaaactggcaaca

SEQ ID NO: 67872 - DNA, 15 bp, Artificial Sequence
  dgRNA
  Sstr4
gagctcttcgggcaa

SEQ ID NO: 67873 - DNA, 15 bp, Artificial Sequence
  dgRNA
  Sstr4
aggttgggcgcgcga

SEQ ID NO: 67874 - DNA, 15 bp, Artificial Sequence
  dgRNA
  Tcp11
gctaaaccacttggg

SEQ ID NO: 67875 - DNA, 15 bp, Artificial Sequence
  dgRNA
  Tcp11
ggctaaaccacttgg

SEQ ID NO: 67876 - DNA, 15 bp, Artificial Sequence
  dgRNA
  Tcp11
gggctaaaccacttg

SEQ ID NO: 67877 - DNA, 15 bp, Artificial Sequence
  dgRNA
  Tcp11
tgggctaaaccactt

SEQ ID NO: 67878 - DNA, 15 bp, Artificial Sequence
  dgRNA
  Prepl
ttgtctcttgctcgc

SEQ ID NO: 67879 - DNA, 15 bp, Artificial Sequence
  dgRNA
  Prepl
gaaaaagcccaccac

SEQ ID NO: 67880 - DNA, 15 bp, Artificial Sequence
  dgRNA
  Prepl
aatgcgcttccctat

SEQ ID NO: 67881 - DNA, 15 bp, Artificial Sequence
  dgRNA
  Prepl
gcttccctatcggtc

SEQ ID NO: 67882 - DNA, 15 bp, Artificial Sequence
  dgRNA
  Heatr6
ctacagttcaaatga

SEQ ID NO: 67883 - DNA, 15 bp, Artificial Sequence
  dgRNA
  Heatr6
atggctttccggaac

SEQ ID NO: 67884 - DNA, 15 bp, Artificial Sequence
  dgRNA
  Heatr6
ccccaagcggtgccc

SEQ ID NO: 67885 - DNA, 15 bp, Artificial Sequence
  dgRNA
  Heatr6
gtttcagattctggc

SEQ ID NO: 67886 - DNA, 15 bp, Artificial Sequence
  dgRNA
  Hecw2
tggagcgccgtcccc

SEQ ID NO: 67887 - DNA, 15 bp, Artificial Sequence
  dgRNA
  Hecw2
ggagcgccgtcccca

SEQ ID NO: 67888 - DNA, 15 bp, Artificial Sequence
  dgRNA
  Hecw2
gcgccgtccccaggg

SEQ ID NO: 67889 - DNA, 15 bp, Artificial Sequence
  dgRNA
  Hecw2
gaggtcccgtgggcc

SEQ ID NO: 67890 - DNA, 15 bp, Artificial Sequence
  dgRNA
  Gm732
aagtgaagtgcacta

SEQ ID NO: 67891 - DNA, 15 bp, Artificial Sequence
  dgRNA
  Gm732
agtgaagtgcactaa

SEQ ID NO: 67892 - DNA, 15 bp, Artificial Sequence
  dgRNA
  Gm732
gtgcactaagggcag

SEQ ID NO: 67893 - DNA, 15 bp, Artificial Sequence
  dgRNA
  Gm732
tgcactaagggcaga

SEQ ID NO: 67894 - DNA, 15 bp, Artificial Sequence
  dgRNA
  Wdsub1
cgtgacccagtgagt

SEQ ID NO: 67895 - DNA, 15 bp, Artificial Sequence
  dgRNA
  Wdsub1
agagcccgactcact

SEQ ID NO: 67896 - DNA, 15 bp, Artificial Sequence
  dgRNA
  Wdsub1
cagagcccgactcac

SEQ ID NO: 67897 - DNA, 15 bp, Artificial Sequence
  dgRNA
  Zp3
tgaataggaatcacg

SEQ ID NO: 67898 - DNA, 15 bp, Artificial Sequence
  dgRNA
  Zp3
ccagattctgatcgt

SEQ ID NO: 67899 - DNA, 15 bp, Artificial Sequence
  dgRNA
  Zp3
tcgttggttcagatg

SEQ ID NO: 67900 - DNA, 15 bp, Artificial Sequence
  dgRNA
  Zp3
ctccacccgagattg

SEQ ID NO: 67901 - DNA, 15 bp, Artificial Sequence
  dgRNA
  Fam83d
ggcgggttctgtctc

SEQ ID NO: 67902 - DNA, 15 bp, Artificial Sequence
  dgRNA
  Fam83d
accaatagcaatgag

SEQ ID NO: 67903 - DNA, 15 bp, Artificial Sequence
  dgRNA
  Fam83d
ccaatagcaatgagg

SEQ ID NO: 67904 - DNA, 15 bp, Artificial Sequence
  dgRNA
  Fam83d
agcctttggtacgca

SEQ ID NO: 67905 - DNA, 15 bp, Artificial Sequence
  dgRNA
  2210408I21Rik
cccggccgaagcttc

SEQ ID NO: 67906 - DNA, 15 bp, Artificial Sequence
  dgRNA
  2210408I21Rik
ccggccgaagcttct

SEQ ID NO: 67907 - DNA, 15 bp, Artificial Sequence
  dgRNA
  2210408I21Rik
ccgaagcttctgggc

SEQ ID NO: 67908 - DNA, 15 bp, Artificial Sequence
  dgRNA
  2210408I21Rik
gtcttgcgaagctgc

SEQ ID NO: 67909 - DNA, 15 bp, Artificial Sequence
  dgRNA
  Ces2f
ctgcgtttagttgtc

SEQ ID NO: 67910 - DNA, 15 bp, Artificial Sequence
  dgRNA
  Ces2f
cacctacattccttt

SEQ ID NO: 67911 - DNA, 15 bp, Artificial Sequence
  dgRNA
  Ces2f
ccttttggtcctgtc

SEQ ID NO: 67912 - DNA, 15 bp, Artificial Sequence
  dgRNA
  Ces2f
aaacgcagaaatgac

SEQ ID NO: 67913 - DNA, 15 bp, Artificial Sequence
  dgRNA
  Ccdc79
ctcccatctaaaacc

SEQ ID NO: 67914 - DNA, 15 bp, Artificial Sequence
  dgRNA
  Ccdc79
gctctacagctgcga

SEQ ID NO: 67915 - DNA, 15 bp, Artificial Sequence
  dgRNA
  Ccdc79
ctctacagctgcgaa

SEQ ID NO: 67916 - DNA, 15 bp, Artificial Sequence
  dgRNA
  Ccdc79
taagcccagtgggac

SEQ ID NO: 67917 - DNA, 15 bp, Artificial Sequence
  dgRNA
  Lao1
acctgggagccttcg

SEQ ID NO: 67918 - DNA, 15 bp, Artificial Sequence
  dgRNA
  Lao1
cctgggagccttcga

SEQ ID NO: 67919 - DNA, 15 bp, Artificial Sequence
  dgRNA
  Lao1
agccttcgagggaga

SEQ ID NO: 67920 - DNA, 15 bp, Artificial Sequence
  dgRNA
  Lao1
gcatgattattgtac

SEQ ID NO: 67921 - DNA, 15 bp, Artificial Sequence
  dgRNA
  Spata24
ggatgaaatccagtc

SEQ ID NO: 67922 - DNA, 15 bp, Artificial Sequence
  dgRNA
  Spata24
caagcccggctctca

SEQ ID NO: 67923 - DNA, 15 bp, Artificial Sequence
  dgRNA
  Spata24
aagcccggctctcaa

SEQ ID NO: 67924 - DNA, 15 bp, Artificial Sequence
  dgRNA
  Spata24
agcccggctctcaag

SEQ ID NO: 67925 - DNA, 15 bp, Artificial Sequence
  dgRNA
  Stard13
aggtcgaacaagccc

SEQ ID NO: 67926 - DNA, 15 bp, Artificial Sequence
  dgRNA
  Depdc1a
ttcaaatcagcagcg

SEQ ID NO: 67927 - DNA, 15 bp, Artificial Sequence
  dgRNA
  Mzf1
aacccgtcgttgcca

SEQ ID NO: 67928 - DNA, 15 bp, Artificial Sequence
  dgRNA
  Mzf1
gcgtcctagtgagag

SEQ ID NO: 67929 - DNA, 15 bp, Artificial Sequence
  dgRNA
  Mzf1
agtgagagcggtgat

SEQ ID NO: 67930 - DNA, 15 bp, Artificial Sequence
  dgRNA
  Mzf1
ctccatggcaacgac

SEQ ID NO: 67931 - DNA, 15 bp, Artificial Sequence
  dgRNA
  Map6d1
tagcaggcttagtga

SEQ ID NO: 67932 - DNA, 15 bp, Artificial Sequence
  dgRNA
  Map6d1
ggcttagtgacggtg

SEQ ID NO: 67933 - DNA, 15 bp, Artificial Sequence
  dgRNA
  Map6d1
acattgggggaactc

SEQ ID NO: 67934 - DNA, 15 bp, Artificial Sequence
  dgRNA
  Map6d1
tttaggactgcccgc

SEQ ID NO: 67935 - DNA, 15 bp, Artificial Sequence
  dgRNA
  Tmc7
gcgcaccgagagagt

SEQ ID NO: 67936 - DNA, 15 bp, Artificial Sequence
  dgRNA
  Tmc7
ccgagagagtaggaa

SEQ ID NO: 67937 - DNA, 15 bp, Artificial Sequence
  dgRNA
  Tmc7
ccaccccgcgcccgt

SEQ ID NO: 67938 - DNA, 15 bp, Artificial Sequence
  dgRNA
  Tmc7
ccgcgcccgtgggaa

SEQ ID NO: 67939 - DNA, 15 bp, Artificial Sequence
  dgRNA
  Olfr1294
tccattagaagtatg

SEQ ID NO: 67940 - DNA, 15 bp, Artificial Sequence
  dgRNA
  Prss28
tcttttcactgacgt

SEQ ID NO: 67941 - DNA, 15 bp, Artificial Sequence
  dgRNA
  Prss28
cgttggacatgttaa

SEQ ID NO: 67942 - DNA, 15 bp, Artificial Sequence
  dgRNA
  Prss28
cttggcacctgcgtc

SEQ ID NO: 67943 - DNA, 15 bp, Artificial Sequence
  dgRNA
  Prss28
tgctaacctagacaa

SEQ ID NO: 67944 - DNA, 15 bp, Artificial Sequence
  dgRNA
  1700012B09Rik
gctggggcctttccg

SEQ ID NO: 67945 - DNA, 15 bp, Artificial Sequence
  dgRNA
  1700012B09Rik
ctggggcctttccgt

SEQ ID NO: 67946 - DNA, 15 bp, Artificial Sequence
  dgRNA
  1700012B09Rik
ggcccggagcatctg

SEQ ID NO: 67947 - DNA, 15 bp, Artificial Sequence
  dgRNA
  1700012B09Rik
agcctacctgctagc

SEQ ID NO: 67948 - DNA, 15 bp, Artificial Sequence
  dgRNA
  Bola1
atttcccgactttgc

SEQ ID NO: 67949 - DNA, 15 bp, Artificial Sequence
  dgRNA
  Bola1
caggattttaccggt

SEQ ID NO: 67950 - DNA, 15 bp, Artificial Sequence
  dgRNA
  Bola1
aggattttaccggtc

SEQ ID NO: 67951 - DNA, 15 bp, Artificial Sequence
  dgRNA
  Bola1
ccggtcgggagaagc

SEQ ID NO: 67952 - DNA, 15 bp, Artificial Sequence
  dgRNA
  Tcp1
tcaccgcagacgttg

SEQ ID NO: 67953 - DNA, 15 bp, Artificial Sequence
  dgRNA
  Tcp1
ccgcagacgttgagg

SEQ ID NO: 67954 - DNA, 15 bp, Artificial Sequence
  dgRNA
  Tcp1
cagacgttgaggcgg

SEQ ID NO: 67955 - DNA, 15 bp, Artificial Sequence
  dgRNA
  Tcp1
agacgttgaggcgga

SEQ ID NO: 67956 - DNA, 15 bp, Artificial Sequence
  dgRNA
  Nhp2l1
gtgccacttcccgag

SEQ ID NO: 67957 - DNA, 15 bp, Artificial Sequence
  dgRNA
  Nhp2l1
ctcttcttccgggaa

SEQ ID NO: 67958 - DNA, 15 bp, Artificial Sequence
  dgRNA
  Nhp2l1
tcttcttccgggaag

SEQ ID NO: 67959 - DNA, 15 bp, Artificial Sequence
  dgRNA
  Nhp2l1
cttcttccgggaagg

SEQ ID NO: 67960 - DNA, 15 bp, Artificial Sequence
  dgRNA
  Ublcp1
gcggccaccaagaac

SEQ ID NO: 67961 - DNA, 15 bp, Artificial Sequence
  dgRNA
  Ublcp1
ccaccaagaaccggg

SEQ ID NO: 67962 - DNA, 15 bp, Artificial Sequence
  dgRNA
  Ublcp1
tggaaaacactcggc

SEQ ID NO: 67963 - DNA, 15 bp, Artificial Sequence
  dgRNA
  Ublcp1
aacactcggccggcc

SEQ ID NO: 67964 - DNA, 15 bp, Artificial Sequence
  dgRNA
  Asap3
agtggggccaacgcg

SEQ ID NO: 67965 - DNA, 15 bp, Artificial Sequence
  dgRNA
  Asap3
gggccaacgcgaggt

SEQ ID NO: 67966 - DNA, 15 bp, Artificial Sequence
  dgRNA
  Asap3
ggccaacgcgaggtt

SEQ ID NO: 67967 - DNA, 15 bp, Artificial Sequence
  dgRNA
  Asap3
gccaacgcgaggttg

SEQ ID NO: 67968 - DNA, 15 bp, Artificial Sequence
  dgRNA
  Klk1b5
tcccaaactactcat

SEQ ID NO: 67969 - DNA, 15 bp, Artificial Sequence
  dgRNA
  Klk1b5
taggctctagtattc

SEQ ID NO: 67970 - DNA, 15 bp, Artificial Sequence
  dgRNA
  C5ar1
ctcctcctcagattg

SEQ ID NO: 67971 - DNA, 15 bp, Artificial Sequence
  dgRNA
  C5ar1
tcagattggggaacg

SEQ ID NO: 67972 - DNA, 15 bp, Artificial Sequence
  dgRNA
  C5ar1
ttggggaacgaggcc

SEQ ID NO: 67973 - DNA, 15 bp, Artificial Sequence
  dgRNA
  C5ar1
gcctacctcttctga

SEQ ID NO: 67974 - DNA, 15 bp, Artificial Sequence
  dgRNA
  Brinp2
gctgctgcaaaaagc

SEQ ID NO: 67975 - DNA, 15 bp, Artificial Sequence
  dgRNA
  Brinp2
gccaaaggagattgc

SEQ ID NO: 67976 - DNA, 15 bp, Artificial Sequence
  dgRNA
  Brinp2
aaggagattgccggt

SEQ ID NO: 67977 - DNA, 15 bp, Artificial Sequence
  dgRNA
  Brinp2
aacccgcctcctgcc

SEQ ID NO: 67978 - DNA, 15 bp, Artificial Sequence
  dgRNA
  Kcnn4
gttaccactccccag

SEQ ID NO: 67979 - DNA, 15 bp, Artificial Sequence
  dgRNA
  Kcnip2
ggtcgctgcgccgcc

SEQ ID NO: 67980 - DNA, 15 bp, Artificial Sequence
  dgRNA
  Kcnip2
gtcgctgcgccgcca

SEQ ID NO: 67981 - DNA, 15 bp, Artificial Sequence
  dgRNA
  Kcnip2
tcgctgcgccgccag

SEQ ID NO: 67982 - DNA, 15 bp, Artificial Sequence
  dgRNA
  Kcnip2
gtgagcgccctatcc

SEQ ID NO: 67983 - DNA, 15 bp, Artificial Sequence
  dgRNA
  6820408C15Rik
gagatgaatgatagc

SEQ ID NO: 67984 - DNA, 15 bp, Artificial Sequence
  dgRNA
  Rsu1
ggcgttcctcagcgt

SEQ ID NO: 67985 - DNA, 15 bp, Artificial Sequence
  dgRNA
  Rsu1
gcgttcctcagcgta

SEQ ID NO: 67986 - DNA, 15 bp, Artificial Sequence
  dgRNA
  Rsu1
ttcctcagcgtaggg

SEQ ID NO: 67987 - DNA, 15 bp, Artificial Sequence
  dgRNA
  Rsu1
taaaacgtgtacgat

SEQ ID NO: 67988 - DNA, 15 bp, Artificial Sequence
  dgRNA
  Larp1
gcgcgccgcgtcgcg

SEQ ID NO: 67989 - DNA, 15 bp, Artificial Sequence
  dgRNA
  Larp1
ccgccgcggatcgcg

SEQ ID NO: 67990 - DNA, 15 bp, Artificial Sequence
  dgRNA
  Larp1
gcggatcgcgtggtc

SEQ ID NO: 67991 - DNA, 15 bp, Artificial Sequence
  dgRNA
  Larp1
tcgcgtggtctggct

SEQ ID NO: 67992 - DNA, 15 bp, Artificial Sequence
  dgRNA
  Olfr47
attctaattatgcac

SEQ ID NO: 67993 - DNA, 15 bp, Artificial Sequence
  dgRNA
  Olfr47
tactcttccaaaagc

SEQ ID NO: 67994 - DNA, 15 bp, Artificial Sequence
  dgRNA
  Olfr47
tagaataattggcac

SEQ ID NO: 67995 - DNA, 15 bp, Artificial Sequence
  dgRNA
  Stat1
acaaccccctgtctg

SEQ ID NO: 67996 - DNA, 15 bp, Artificial Sequence
  dgRNA
  Stat1
gtttgcaccgcacag

SEQ ID NO: 67997 - DNA, 15 bp, Artificial Sequence
  dgRNA
  Stat1
ccaagtttcgcacgc

SEQ ID NO: 67998 - DNA, 15 bp, Artificial Sequence
  dgRNA
  Stat1
caagtttcgcacgcc

SEQ ID NO: 67999 - DNA, 15 bp, Artificial Sequence
  dgRNA
  Gnb3
gtcaccctcctgttc

SEQ ID NO: 68000 - DNA, 15 bp, Artificial Sequence
  dgRNA
  Gnb3
cccgcttgctgaaca

SEQ ID NO: 68001 - DNA, 15 bp, Artificial Sequence
  dgRNA
  Gnb3
aaccagtaatcctca

SEQ ID NO: 68002 - DNA, 15 bp, Artificial Sequence
  dgRNA
  Gnb3
cttgtctctgatccg

SEQ ID NO: 68003 - DNA, 15 bp, Artificial Sequence
  dgRNA
  Lrrc4c
aatccaattgcgcac

SEQ ID NO: 68004 - DNA, 15 bp, Artificial Sequence
  dgRNA
  Lrrc4c
atccaattgcgcact

SEQ ID NO: 68005 - DNA, 15 bp, Artificial Sequence
  dgRNA
  Lrrc4c
tcagatctttgacga

SEQ ID NO: 68006 - DNA, 15 bp, Artificial Sequence
  dgRNA
  Lrrc4c
cagatctttgacgaa

SEQ ID NO: 68007 - DNA, 15 bp, Artificial Sequence
  dgRNA
  Smg6
acctccgagcctcgg

SEQ ID NO: 68008 - DNA, 15 bp, Artificial Sequence
  dgRNA
  Smg6
cacacgccgtctccg

SEQ ID NO: 68009 - DNA, 15 bp, Artificial Sequence
  dgRNA
  Smg6
ccgattcgcccgctc

SEQ ID NO: 68010 - DNA, 15 bp, Artificial Sequence
  dgRNA
  Smg6
tcgcccgctccggca

SEQ ID NO: 68011 - DNA, 15 bp, Artificial Sequence
  dgRNA
  Cabp5
tatccaattccattc

SEQ ID NO: 68012 - DNA, 15 bp, Artificial Sequence
  dgRNA
  Cabp5
actccagccataaat

SEQ ID NO: 68013 - DNA, 15 bp, Artificial Sequence
  dgRNA
  Cabp5
agggggagccaatgt

SEQ ID NO: 68014 - DNA, 15 bp, Artificial Sequence
  dgRNA
  Cabp5
cctacctcccattta

SEQ ID NO: 68015 - DNA, 15 bp, Artificial Sequence
  dgRNA
  Map1a
tggctcaagtcggag

SEQ ID NO: 68016 - DNA, 15 bp, Artificial Sequence
  dgRNA
  Map1a
ggctcaagtcggaga

SEQ ID NO: 68017 - DNA, 15 bp, Artificial Sequence
  dgRNA
  Map1a
gctcaagtcggagag

SEQ ID NO: 68018 - DNA, 15 bp, Artificial Sequence
  dgRNA
  Map1a
tcggagaggggcact

SEQ ID NO: 68019 - DNA, 15 bp, Artificial Sequence
  dgRNA
  Tle4
cacagtagccgcgcg

SEQ ID NO: 68020 - DNA, 15 bp, Artificial Sequence
  dgRNA
  Tle4
cccgggatgctcctt

SEQ ID NO: 68021 - DNA, 15 bp, Artificial Sequence
  dgRNA
  Tle4
tccttgggccctccg

SEQ ID NO: 68022 - DNA, 15 bp, Artificial Sequence
  dgRNA
  Tle4
tgggccctccgcgga

SEQ ID NO: 68023 - DNA, 15 bp, Artificial Sequence
  dgRNA
  Ccser2
gtagctgcagtttag

SEQ ID NO: 68024 - DNA, 15 bp, Artificial Sequence
  dgRNA
  Ccser2
agtagctgcagttta

SEQ ID NO: 68025 - DNA, 15 bp, Artificial Sequence
  dgRNA
  A430105I19Rik
gatcacaggtgaaag

SEQ ID NO: 68026 - DNA, 15 bp, Artificial Sequence
  dgRNA
  A430105I19Rik
tagatctcctgtgcg

SEQ ID NO: 68027 - DNA, 15 bp, Artificial Sequence
  dgRNA
  A430105I19Rik
ctagacaagaccagc

SEQ ID NO: 68028 - DNA, 15 bp, Artificial Sequence
  dgRNA
  A430105I19Rik
agaccagccggctgc

SEQ ID NO: 68029 - DNA, 15 bp, Artificial Sequence
  dgRNA
  Ppargc1b
gggggctgcgagacc

SEQ ID NO: 68030 - DNA, 15 bp, Artificial Sequence
  dgRNA
  Ppargc1b
cgctagactaggagc

SEQ ID NO: 68031 - DNA, 15 bp, Artificial Sequence
  dgRNA
  Ppargc1b
gagcaggaaaagccg

SEQ ID NO: 68032 - DNA, 15 bp, Artificial Sequence
  dgRNA
  Ppargc1b
cgggggtgcgacccc

SEQ ID NO: 68033 - DNA, 15 bp, Artificial Sequence
  dgRNA
  Rad23a
cggaagtgcttggcg

SEQ ID NO: 68034 - DNA, 15 bp, Artificial Sequence
  dgRNA
  Rad23a
gtgcttggcgcggcg

SEQ ID NO: 68035 - DNA, 15 bp, Artificial Sequence
  dgRNA
  Rad23a
cgccaagcacttccg

SEQ ID NO: 68036 - DNA, 15 bp, Artificial Sequence
  dgRNA
  Rad23a
gcgccaagcacttcc

SEQ ID NO: 68037 - DNA, 15 bp, Artificial Sequence
  dgRNA
  Synpr
agtttccccggagcc

SEQ ID NO: 68038 - DNA, 15 bp, Artificial Sequence
  dgRNA
  Synpr
cccgcgcgcaggatc

SEQ ID NO: 68039 - DNA, 15 bp, Artificial Sequence
  dgRNA
  Synpr
tggaccaatgtgcga

SEQ ID NO: 68040 - DNA, 15 bp, Artificial Sequence
  dgRNA
  Synpr
aaacgccctcccccg

SEQ ID NO: 68041 - DNA, 15 bp, Artificial Sequence
  dgRNA
  Abcb1b
acccaccaggctgat

SEQ ID NO: 68042 - DNA, 15 bp, Artificial Sequence
  dgRNA
  Abcb1b
ggctgccgggcctta

SEQ ID NO: 68043 - DNA, 15 bp, Artificial Sequence
  dgRNA
  Abcb1b
tgccgggccttaggg

SEQ ID NO: 68044 - DNA, 15 bp, Artificial Sequence
  dgRNA
  Abcb1b
ccttagggcggccgc

SEQ ID NO: 68045 - DNA, 15 bp, Artificial Sequence
  dgRNA
  Krt14
ctggtgaatcatgcc

SEQ ID NO: 68046 - DNA, 15 bp, Artificial Sequence
  dgRNA
  Krt14
gtgaatcatgcctgg

SEQ ID NO: 68047 - DNA, 15 bp, Artificial Sequence
  dgRNA
  Krt14
gacatgatgaggcgg

SEQ ID NO: 68048 - DNA, 15 bp, Artificial Sequence
  dgRNA
  Krt14
aggagggatctgatc

SEQ ID NO: 68049 - DNA, 15 bp, Artificial Sequence
  dgRNA
  Pds5b
ggaggccgcgccagc

SEQ ID NO: 68050 - DNA, 15 bp, Artificial Sequence
  dgRNA
  Pds5b
gaggccgcgccagca

SEQ ID NO: 68051 - DNA, 15 bp, Artificial Sequence
  dgRNA
  Pds5b
gccgcgccagcaggg

SEQ ID NO: 68052 - DNA, 15 bp, Artificial Sequence
  dgRNA
  Pds5b
gcgcccccgggtgtg

SEQ ID NO: 68053 - DNA, 15 bp, Artificial Sequence
  dgRNA
  Sigmar1
ctgggtctccccgct

SEQ ID NO: 68054 - DNA, 15 bp, Artificial Sequence
  dgRNA
  Sigmar1
tgggtctccccgctt

SEQ ID NO: 68055 - DNA, 15 bp, Artificial Sequence
  dgRNA
  Sigmar1
gggtctccccgcttg

SEQ ID NO: 68056 - DNA, 15 bp, Artificial Sequence
  dgRNA
  Sigmar1
aagattgaacccaac

SEQ ID NO: 68057 - DNA, 15 bp, Artificial Sequence
  dgRNA
  Dhx36
ttccccgccatccga

SEQ ID NO: 68058 - DNA, 15 bp, Artificial Sequence
  dgRNA
  Dhx36
gaaggacgcccaccc

SEQ ID NO: 68059 - DNA, 15 bp, Artificial Sequence
  dgRNA
  Dhx36
caggagctaagtttc

SEQ ID NO: 68060 - DNA, 15 bp, Artificial Sequence
  dgRNA
  Dhx36
ccagaacacgaaccg

SEQ ID NO: 68061 - DNA, 15 bp, Artificial Sequence
  dgRNA
  Ccdc74a
ccggacgtcgagtgc

SEQ ID NO: 68062 - DNA, 15 bp, Artificial Sequence
  dgRNA
  Ccdc74a
accagttcaagagtc

SEQ ID NO: 68063 - DNA, 15 bp, Artificial Sequence
  dgRNA
  Ccdc74a
aagagtctggcgcct

SEQ ID NO: 68064 - DNA, 15 bp, Artificial Sequence
  dgRNA
  Ccdc74a
gcgccttggtttttg

SEQ ID NO: 68065 - DNA, 15 bp, Artificial Sequence
  dgRNA
  Mb21d2
ggaggaccgggggcc

SEQ ID NO: 68066 - DNA, 15 bp, Artificial Sequence
  dgRNA
  Mb21d2
gaggaccgggggccg

SEQ ID NO: 68067 - DNA, 15 bp, Artificial Sequence
  dgRNA
  Mb21d2
gcacctcgccgcagt

SEQ ID NO: 68068 - DNA, 15 bp, Artificial Sequence
  dgRNA
  Mb21d2
cacctcgccgcagtc

SEQ ID NO: 68069 - DNA, 15 bp, Artificial Sequence
  dgRNA
  Rpap2
cccccagcccggttc

SEQ ID NO: 68070 - DNA, 15 bp, Artificial Sequence
  dgRNA
  Rpap2
ccccagcccggttcc

SEQ ID NO: 68071 - DNA, 15 bp, Artificial Sequence
  dgRNA
  Rpap2
tccgggcgaagcgtg

SEQ ID NO: 68072 - DNA, 15 bp, Artificial Sequence
  dgRNA
  Rpap2
gggcgaagcgtgagg

SEQ ID NO: 68073 - DNA, 15 bp, Artificial Sequence
  dgRNA
  Zbtb16
ccccttccccgatcc

SEQ ID NO: 68074 - DNA, 15 bp, Artificial Sequence
  dgRNA
  Zbtb16
tccaggctccgtaag

SEQ ID NO: 68075 - DNA, 15 bp, Artificial Sequence
  dgRNA
  Zbtb16
gtaggaaacccggga

SEQ ID NO: 68076 - DNA, 15 bp, Artificial Sequence
  dgRNA
  Zbtb16
cgaccgcctcccgcc

SEQ ID NO: 68077 - DNA, 15 bp, Artificial Sequence
  dgRNA
  Panx3
tactgtattaatcag

SEQ ID NO: 68078 - DNA, 15 bp, Artificial Sequence
  dgRNA
  Panx3
cagtgcttcgtctgt

SEQ ID NO: 68079 - DNA, 15 bp, Artificial Sequence
  dgRNA
  Panx3
agtgcttcgtctgtt

SEQ ID NO: 68080 - DNA, 15 bp, Artificial Sequence
  dgRNA
  Panx3
agtgaggactcaccg

SEQ ID NO: 68081 - DNA, 15 bp, Artificial Sequence
  dgRNA
  Fbxl15
cagctagttatagtc

SEQ ID NO: 68082 - DNA, 15 bp, Artificial Sequence
  dgRNA
  Fbxl15
agctagttatagtct

SEQ ID NO: 68083 - DNA, 15 bp, Artificial Sequence
  dgRNA
  Fbxl15
tccaaagtcgcttaa

SEQ ID NO: 68084 - DNA, 15 bp, Artificial Sequence
  dgRNA
  Fbxl15
cttaaaggcgaccag

SEQ ID NO: 68085 - DNA, 15 bp, Artificial Sequence
  dgRNA
  Arg1
caaaagggtgtgaac

SEQ ID NO: 68086 - DNA, 15 bp, Artificial Sequence
  dgRNA
  Arg1
ggtagttcctctgat

SEQ ID NO: 68087 - DNA, 15 bp, Artificial Sequence
  dgRNA
  Arg1
cattcttccattcgg

SEQ ID NO: 68088 - DNA, 15 bp, Artificial Sequence
  dgRNA
  Arg1
attcttccattcggt

SEQ ID NO: 68089 - DNA, 15 bp, Artificial Sequence
  dgRNA
  Mbnl3
aagccactctcggcg

SEQ ID NO: 68090 - DNA, 15 bp, Artificial Sequence
  dgRNA
  Mbnl3
agccactctcggcga

SEQ ID NO: 68091 - DNA, 15 bp, Artificial Sequence
  dgRNA
  Mbnl3
ccacgccagcagtct

SEQ ID NO: 68092 - DNA, 15 bp, Artificial Sequence
  dgRNA
  Mbnl3
cacgccagcagtctc

SEQ ID NO: 68093 - DNA, 15 bp, Artificial Sequence
  dgRNA
  Map2k5
agatccgtgtcttcc

SEQ ID NO: 68094 - DNA, 15 bp, Artificial Sequence
  dgRNA
  Map2k5
gatccgtgtcttcct

SEQ ID NO: 68095 - DNA, 15 bp, Artificial Sequence
  dgRNA
  Map2k5
acatggcgccccagg

SEQ ID NO: 68096 - DNA, 15 bp, Artificial Sequence
  dgRNA
  Map2k5
tggcgccccaggagg

SEQ ID NO: 68097 - DNA, 15 bp, Artificial Sequence
  dgRNA
  Stk31
ctttcgggagcagag

SEQ ID NO: 68098 - DNA, 15 bp, Artificial Sequence
  dgRNA
  Stk31
agcggagcgcgtgcg

SEQ ID NO: 68099 - DNA, 15 bp, Artificial Sequence
  dgRNA
  Stk31
cgcgtgcgtggaccg

SEQ ID NO: 68100 - DNA, 15 bp, Artificial Sequence
  dgRNA
  Stk31
gcgtgcgtggaccgt

SEQ ID NO: 68101 - DNA, 15 bp, Artificial Sequence
  dgRNA
  Prss29
cgagcagttcccgtc

SEQ ID NO: 68102 - DNA, 15 bp, Artificial Sequence
  dgRNA
  Prss29
tctttttgctgacgt

SEQ ID NO: 68103 - DNA, 15 bp, Artificial Sequence
  dgRNA
  Prss29
ggtttgagcttgacc

SEQ ID NO: 68104 - DNA, 15 bp, Artificial Sequence
  dgRNA
  Prss29
atcacattcaatgac

SEQ ID NO: 68105 - DNA, 15 bp, Artificial Sequence
  dgRNA
  Cyp2j12
aagcttatgagggcg

SEQ ID NO: 68106 - DNA, 15 bp, Artificial Sequence
  dgRNA
  Cyp2j12
tatgagggcggggct

SEQ ID NO: 68107 - DNA, 15 bp, Artificial Sequence
  dgRNA
  Cyp2j12
ggattaagtgcaaag

SEQ ID NO: 68108 - DNA, 15 bp, Artificial Sequence
  dgRNA
  Cyp2j12
gtggacaaggagttc

SEQ ID NO: 68109 - DNA, 15 bp, Artificial Sequence
  dgRNA
  Usp49
gagctgggcgttaat

SEQ ID NO: 68110 - DNA, 15 bp, Artificial Sequence
  dgRNA
  Usp49
ttaataggacagttc

SEQ ID NO: 68111 - DNA, 15 bp, Artificial Sequence
  dgRNA
  Usp49
agaaacaacgctgaa

SEQ ID NO: 68112 - DNA, 15 bp, Artificial Sequence
  dgRNA
  Usp49
aaaggacgctagaag

SEQ ID NO: 68113 - DNA, 15 bp, Artificial Sequence
  dgRNA
  Arid3a
tgactttccgctcag

SEQ ID NO: 68114 - DNA, 15 bp, Artificial Sequence
  dgRNA
  Arid3a
ctttccgctcagagg

SEQ ID NO: 68115 - DNA, 15 bp, Artificial Sequence
  dgRNA
  Arid3a
tttccgctcagaggt

SEQ ID NO: 68116 - DNA, 15 bp, Artificial Sequence
  dgRNA
  Arid3a
ttccgctcagaggtg

SEQ ID NO: 68117 - DNA, 15 bp, Artificial Sequence
  dgRNA
  Ctxn2
attatttacacacgt

SEQ ID NO: 68118 - DNA, 15 bp, Artificial Sequence
  dgRNA
  Ctxn2
ttacacacgtaggcc

SEQ ID NO: 68119 - DNA, 15 bp, Artificial Sequence
  dgRNA
  Ctxn2
ggaaagcgctaccca

SEQ ID NO: 68120 - DNA, 15 bp, Artificial Sequence
  dgRNA
  Ctxn2
tacacgaaccgagat

SEQ ID NO: 68121 - DNA, 15 bp, Artificial Sequence
  dgRNA
  Map3k13
agagtgtaggtacta

SEQ ID NO: 68122 - DNA, 15 bp, Artificial Sequence
  dgRNA
  Map3k13
ggtttgatgcaagag

SEQ ID NO: 68123 - DNA, 15 bp, Artificial Sequence
  dgRNA
  Golm1
tccgcaagtaacctc

SEQ ID NO: 68124 - DNA, 15 bp, Artificial Sequence
  dgRNA
  Golm1
ccgcaagtaacctca

SEQ ID NO: 68125 - DNA, 15 bp, Artificial Sequence
  dgRNA
  Golm1
cgcaagtaacctcag

SEQ ID NO: 68126 - DNA, 15 bp, Artificial Sequence
  dgRNA
  Golm1
tcaccattggcagtg

SEQ ID NO: 68127 - DNA, 15 bp, Artificial Sequence
  dgRNA
  Lelp1
tagattctcatgtcc

SEQ ID NO: 68128 - DNA, 15 bp, Artificial Sequence
  dgRNA
  Lelp1
atgttgggtgacttc

SEQ ID NO: 68129 - DNA, 15 bp, Artificial Sequence
  dgRNA
  Lelp1
atgagtagtgaatgt

SEQ ID NO: 68130 - DNA, 15 bp, Artificial Sequence
  dgRNA
  Becn1
gtaacaaatcttgag

SEQ ID NO: 68131 - DNA, 15 bp, Artificial Sequence
  dgRNA
  Becn1
cttcggcccacctgt

SEQ ID NO: 68132 - DNA, 15 bp, Artificial Sequence
  dgRNA
  Becn1
ctgcacttccccgct

SEQ ID NO: 68133 - DNA, 15 bp, Artificial Sequence
  dgRNA
  Becn1
tccccgctcggcctt

SEQ ID NO: 68134 - DNA, 15 bp, Artificial Sequence
  dgRNA
  Zfand6
cctaacctgctagcg

SEQ ID NO: 68135 - DNA, 15 bp, Artificial Sequence
  dgRNA
  Zfand6
gcctcactaacaggg

SEQ ID NO: 68136 - DNA, 15 bp, Artificial Sequence
  dgRNA
  Zfand6
ggagatttgactctc

SEQ ID NO: 68137 - DNA, 15 bp, Artificial Sequence
  dgRNA
  Zfand6
ggccactagaattgc

SEQ ID NO: 68138 - DNA, 15 bp, Artificial Sequence
  dgRNA
  Serpinb6e
tgccctattgccact

SEQ ID NO: 68139 - DNA, 15 bp, Artificial Sequence
  dgRNA
  Serpinb6e
gccctattgccactt

SEQ ID NO: 68140 - DNA, 15 bp, Artificial Sequence
  dgRNA
  Serpinb6e
tattgccacttggga

SEQ ID NO: 68141 - DNA, 15 bp, Artificial Sequence
  dgRNA
  Serpinb6e
ccacttgggatggcc

SEQ ID NO: 68142 - DNA, 15 bp, Artificial Sequence
  dgRNA
  Psmd4
agcttacagctgttc

SEQ ID NO: 68143 - DNA, 15 bp, Artificial Sequence
  dgRNA
  Psmd4
cggaagctgctgcga

SEQ ID NO: 68144 - DNA, 15 bp, Artificial Sequence
  dgRNA
  Psmd4
ggtagccaactctat

SEQ ID NO: 68145 - DNA, 15 bp, Artificial Sequence
  dgRNA
  Psmd4
tcccagaacacaccg

SEQ ID NO: 68146 - DNA, 15 bp, Artificial Sequence
  dgRNA
  Bzw2
cctattaagaagtac

SEQ ID NO: 68147 - DNA, 15 bp, Artificial Sequence
  dgRNA
  Bzw2
ctattaagaagtaca

SEQ ID NO: 68148 - DNA, 15 bp, Artificial Sequence
  dgRNA
  Bzw2
gttccttggattcta

SEQ ID NO: 68149 - DNA, 15 bp, Artificial Sequence
  dgRNA
  Bzw2
tgtgggcacgtgcgg

SEQ ID NO: 68150 - DNA, 15 bp, Artificial Sequence
  dgRNA
  Uck1
atggggttaagcata

SEQ ID NO: 68151 - DNA, 15 bp, Artificial Sequence
  dgRNA
  Uck1
ggttaagcataaggc

SEQ ID NO: 68152 - DNA, 15 bp, Artificial Sequence
  dgRNA
  Uck1
gttaagcataaggca

SEQ ID NO: 68153 - DNA, 15 bp, Artificial Sequence
  dgRNA
  Uck1
acggtcctaaccctg

SEQ ID NO: 68154 - DNA, 15 bp, Artificial Sequence
  dgRNA
  Aplp1
gcggacagtgacacc

SEQ ID NO: 68155 - DNA, 15 bp, Artificial Sequence
  dgRNA
  Aplp1
gcaggctccctcccg

SEQ ID NO: 68156 - DNA, 15 bp, Artificial Sequence
  dgRNA
  Aplp1
tccctcccggggttc

SEQ ID NO: 68157 - DNA, 15 bp, Artificial Sequence
  dgRNA
  Aplp1
gccacgctattgtcc

SEQ ID NO: 68158 - DNA, 15 bp, Artificial Sequence
  dgRNA
  Rmnd1
tttggtggtctggcc

SEQ ID NO: 68159 - DNA, 15 bp, Artificial Sequence
  dgRNA
  Rmnd1
agaacatggggcgca

SEQ ID NO: 68160 - DNA, 15 bp, Artificial Sequence
  dgRNA
  Rmnd1
gaacatggggcgcaa

SEQ ID NO: 68161 - DNA, 15 bp, Artificial Sequence
  dgRNA
  Rmnd1
ggcgcaagggccttc

SEQ ID NO: 68162 - DNA, 15 bp, Artificial Sequence
  dgRNA
  Dusp27
tgagaatcagccgga

SEQ ID NO: 68163 - DNA, 15 bp, Artificial Sequence
  dgRNA
  Dusp27
gagaatcagccggaa

SEQ ID NO: 68164 - DNA, 15 bp, Artificial Sequence
  dgRNA
  Dusp27
tcagccggaagggaa

SEQ ID NO: 68165 - DNA, 15 bp, Artificial Sequence
  dgRNA
  Dusp27
accatctcccgcagg

SEQ ID NO: 68166 - DNA, 15 bp, Artificial Sequence
  dgRNA
  Dmrta1
ggccagcctacccag

SEQ ID NO: 68167 - DNA, 15 bp, Artificial Sequence
  dgRNA
  Dmrta1
gccagcctacccagt

SEQ ID NO: 68168 - DNA, 15 bp, Artificial Sequence
  dgRNA
  Dmrta1
agcctacccagtggg

SEQ ID NO: 68169 - DNA, 15 bp, Artificial Sequence
  dgRNA
  Dmrta1
cctacccagtgggcg

SEQ ID NO: 68170 - DNA, 15 bp, Artificial Sequence
  dgRNA
  Srp68
ccacgaattcaaccc

SEQ ID NO: 68171 - DNA, 15 bp, Artificial Sequence
  dgRNA
  Srp68
cgaattcaacccagg

SEQ ID NO: 68172 - DNA, 15 bp, Artificial Sequence
  dgRNA
  Srp68
ggcccaagacatccg

SEQ ID NO: 68173 - DNA, 15 bp, Artificial Sequence
  dgRNA
  Srp68
tctaccaaggatagg

SEQ ID NO: 68174 - DNA, 15 bp, Artificial Sequence
  dgRNA
  Olfr1418
agtatgttatgtagc

SEQ ID NO: 68175 - DNA, 15 bp, Artificial Sequence
  dgRNA
  Olfr1418
taaaacttaggcata

SEQ ID NO: 68176 - DNA, 15 bp, Artificial Sequence
  dgRNA
  Olfr1418
attgaacctacctgg

SEQ ID NO: 68177 - DNA, 15 bp, Artificial Sequence
  dgRNA
  Itpripl1
tcttggcttcgagca

SEQ ID NO: 68178 - DNA, 15 bp, Artificial Sequence
  dgRNA
  Itpripl1
cttggcttcgagcaa

SEQ ID NO: 68179 - DNA, 15 bp, Artificial Sequence
  dgRNA
  Itpripl1
ttggcttcgagcaag

SEQ ID NO: 68180 - DNA, 15 bp, Artificial Sequence
  dgRNA
  Itpripl1
gcttcgagcaagggg

SEQ ID NO: 68181 - DNA, 15 bp, Artificial Sequence
  dgRNA
  Sh3tc2
agtgcgaggactatc

SEQ ID NO: 68182 - DNA, 15 bp, Artificial Sequence
  dgRNA
  Sh3tc2
gactatctggcctgc

SEQ ID NO: 68183 - DNA, 15 bp, Artificial Sequence
  dgRNA
  Sh3tc2
caggccggatatcaa

SEQ ID NO: 68184 - DNA, 15 bp, Artificial Sequence
  dgRNA
  Sh3tc2
ccctcctcgtgtgcc

SEQ ID NO: 68185 - DNA, 15 bp, Artificial Sequence
  dgRNA
  Ly86
tatgtgaaagccccc

SEQ ID NO: 68186 - DNA, 15 bp, Artificial Sequence
  dgRNA
  Ly86
cgctttcacaggaag

SEQ ID NO: 68187 - DNA, 15 bp, Artificial Sequence
  dgRNA
  Ly86
acttctcgctttcac

SEQ ID NO: 68188 - DNA, 15 bp, Artificial Sequence
  dgRNA
  Ly86
atgggctaggttgaa

SEQ ID NO: 68189 - DNA, 15 bp, Artificial Sequence
  dgRNA
  Fam206a
cctacgacgccctcg

SEQ ID NO: 68190 - DNA, 15 bp, Artificial Sequence
  dgRNA
  Fam206a
acgacgccctcgagg

SEQ ID NO: 68191 - DNA, 15 bp, Artificial Sequence
  dgRNA
  Fam206a
ggctccgagccctca

SEQ ID NO: 68192 - DNA, 15 bp, Artificial Sequence
  dgRNA
  Fam206a
gccctcacggcgcac

SEQ ID NO: 68193 - DNA, 15 bp, Artificial Sequence
  dgRNA
  Ctsr
aggcactcctacctc

SEQ ID NO: 68194 - DNA, 15 bp, Artificial Sequence
  dgRNA
  Mapk8ip1
acgtgcaaactctag

SEQ ID NO: 68195 - DNA, 15 bp, Artificial Sequence
  dgRNA
  Mapk8ip1
ccgacccaacagtcc

SEQ ID NO: 68196 - DNA, 15 bp, Artificial Sequence
  dgRNA
  Mapk8ip1
gcagaagcctcgccg

SEQ ID NO: 68197 - DNA, 15 bp, Artificial Sequence
  dgRNA
  Mapk8ip1
gaagcctcgccgagg

SEQ ID NO: 68198 - DNA, 15 bp, Artificial Sequence
  dgRNA
  Crygs
agcctacaatgcagt

SEQ ID NO: 68199 - DNA, 15 bp, Artificial Sequence
  dgRNA
  Crygs
ctgggcgagcattac

SEQ ID NO: 68200 - DNA, 15 bp, Artificial Sequence
  dgRNA
  Crygs
tgggcgagcattaca

SEQ ID NO: 68201 - DNA, 15 bp, Artificial Sequence
  dgRNA
  Crygs
gggcgagcattacag

SEQ ID NO: 68202 - DNA, 15 bp, Artificial Sequence
  dgRNA
  Siglecf
agtgctgataacctg

SEQ ID NO: 68203 - DNA, 15 bp, Artificial Sequence
  dgRNA
  Siglecf
gtgctgataacctgt

SEQ ID NO: 68204 - DNA, 15 bp, Artificial Sequence
  dgRNA
  Siglecf
ctgataacctgtggg

SEQ ID NO: 68205 - DNA, 15 bp, Artificial Sequence
  dgRNA
  Siglecf
ctggactaggttagt

SEQ ID NO: 68206 - DNA, 15 bp, Artificial Sequence
  dgRNA
  Cdca3
caagacgcgcgagat

SEQ ID NO: 68207 - DNA, 15 bp, Artificial Sequence
  dgRNA
  Cdca3
cgcgagatcggcagt

SEQ ID NO: 68208 - DNA, 15 bp, Artificial Sequence
  dgRNA
  Cdca3
caataaaaagcgccg

SEQ ID NO: 68209 - DNA, 15 bp, Artificial Sequence
  dgRNA
  Cdca3
aataaaaagcgccgc

SEQ ID NO: 68210 - DNA, 15 bp, Artificial Sequence
  dgRNA
  Folh1
tagcctaactacaat

SEQ ID NO: 68211 - DNA, 15 bp, Artificial Sequence
  dgRNA
  Folh1
cagtacgccagaatt

SEQ ID NO: 68212 - DNA, 15 bp, Artificial Sequence
  dgRNA
  Folh1
agtacgccagaattt

SEQ ID NO: 68213 - DNA, 15 bp, Artificial Sequence
  dgRNA
  Folh1
gtacgccagaatttg

SEQ ID NO: 68214 - DNA, 15 bp, Artificial Sequence
  dgRNA
  Rpl15
ccgacctgcttcctc

SEQ ID NO: 68215 - DNA, 15 bp, Artificial Sequence
  dgRNA
  Rpl15
cactttccgcagcct

SEQ ID NO: 68216 - DNA, 15 bp, Artificial Sequence
  dgRNA
  Rpl15
agcatccggaagcgg

SEQ ID NO: 68217 - DNA, 15 bp, Artificial Sequence
  dgRNA
  Rpl15
gcatccggaagcggc

SEQ ID NO: 68218 - DNA, 15 bp, Artificial Sequence
  dgRNA
  Nim1k
gccaaccccccgctc

SEQ ID NO: 68219 - DNA, 15 bp, Artificial Sequence
  dgRNA
  Nim1k
ccccccgctcaggat

SEQ ID NO: 68220 - DNA, 15 bp, Artificial Sequence
  dgRNA
  Nim1k
ggattggtcctgttc

SEQ ID NO: 68221 - DNA, 15 bp, Artificial Sequence
  dgRNA
  Nim1k
tccgggagggggttt

SEQ ID NO: 68222 - DNA, 15 bp, Artificial Sequence
  dgRNA
  Commd1
gccatcgaagaatta

SEQ ID NO: 68223 - DNA, 15 bp, Artificial Sequence
  dgRNA
  Commd1
tacggagttacagtt

SEQ ID NO: 68224 - DNA, 15 bp, Artificial Sequence
  dgRNA
  Commd1
tgcgcatttgcacat

SEQ ID NO: 68225 - DNA, 15 bp, Artificial Sequence
  dgRNA
  Commd1
acatcggagtgaaga

SEQ ID NO: 68226 - DNA, 15 bp, Artificial Sequence
  dgRNA
  Rhobtb1
tgaaatccaatcgtg

SEQ ID NO: 68227 - DNA, 15 bp, Artificial Sequence
  dgRNA
  Rhobtb1
tataaatagccgcca

SEQ ID NO: 68228 - DNA, 15 bp, Artificial Sequence
  dgRNA
  Rhobtb1
ctgctcacgtcacgg

SEQ ID NO: 68229 - DNA, 15 bp, Artificial Sequence
  dgRNA
  Rhobtb1
tgctcgctccgtgcc

SEQ ID NO: 68230 - DNA, 15 bp, Artificial Sequence
  dgRNA
  Fam57b
agtactcctgctagg

SEQ ID NO: 68231 - DNA, 15 bp, Artificial Sequence
  dgRNA
  Fam57b
taggtggaggtgtcc

SEQ ID NO: 68232 - DNA, 15 bp, Artificial Sequence
  dgRNA
  Fam57b
aggtggaggtgtccg

SEQ ID NO: 68233 - DNA, 15 bp, Artificial Sequence
  dgRNA
  Fam57b
ggtggaggtgtccgg

SEQ ID NO: 68234 - DNA, 15 bp, Artificial Sequence
  dgRNA
  Fgg
tcactcgtgctctga

SEQ ID NO: 68235 - DNA, 15 bp, Artificial Sequence
  dgRNA
  Fgg
ctcactcgtgctctg

SEQ ID NO: 68236 - DNA, 15 bp, Artificial Sequence
  dgRNA
  Fgg
tctgggcgggactaa

SEQ ID NO: 68237 - DNA, 15 bp, Artificial Sequence
  dgRNA
  Fgg
gtctgggcgggacta

SEQ ID NO: 68238 - DNA, 15 bp, Artificial Sequence
  dgRNA
  CAAA01180111.1
caaggagagtttttc

SEQ ID NO: 68239 - DNA, 15 bp, Artificial Sequence
  dgRNA
  CAAA01180111.1
cgggtgccatgttgc

SEQ ID NO: 68240 - DNA, 15 bp, Artificial Sequence
  dgRNA
  CAAA01180111.1
ctgcaacatggcacc

SEQ ID NO: 68241 - DNA, 15 bp, Artificial Sequence
  dgRNA
  Acpp
gcacttccctcccga

SEQ ID NO: 68242 - DNA, 15 bp, Artificial Sequence
  dgRNA
  Atg14
tttggcgccactcca

SEQ ID NO: 68243 - DNA, 15 bp, Artificial Sequence
  dgRNA
  Atg14
ttggcgccactccaa

SEQ ID NO: 68244 - DNA, 15 bp, Artificial Sequence
  dgRNA
  Atg14
actgcgcagccgcca

SEQ ID NO: 68245 - DNA, 15 bp, Artificial Sequence
  dgRNA
  Atg14
agccgccaaggagtg

SEQ ID NO: 68246 - DNA, 15 bp, Artificial Sequence
  dgRNA
  Uty
ttcactgtggtcggt

SEQ ID NO: 68247 - DNA, 15 bp, Artificial Sequence
  dgRNA
  Uty
caagtttagctgcac

SEQ ID NO: 68248 - DNA, 15 bp, Artificial Sequence
  dgRNA
  Uty
caacaaaagtcacgt

SEQ ID NO: 68249 - DNA, 15 bp, Artificial Sequence
  dgRNA
  Uty
tcacgtgggataaaa

SEQ ID NO: 68250 - DNA, 15 bp, Artificial Sequence
  dgRNA
  Dennd2a
acccctcgaaaggcg

SEQ ID NO: 68251 - DNA, 15 bp, Artificial Sequence
  dgRNA
  Dennd2a
cccctcgaaaggcga

SEQ ID NO: 68252 - DNA, 15 bp, Artificial Sequence
  dgRNA
  Dennd2a
ccctcgaaaggcgag

SEQ ID NO: 68253 - DNA, 15 bp, Artificial Sequence
  dgRNA
  Dennd2a
cctcgaaaggcgagg

SEQ ID NO: 68254 - DNA, 15 bp, Artificial Sequence
  dgRNA
  Anks1b
ctttctaatgaacag

SEQ ID NO: 68255 - DNA, 15 bp, Artificial Sequence
  dgRNA
  Anks1b
agaggcttggctcgg

SEQ ID NO: 68256 - DNA, 15 bp, Artificial Sequence
  dgRNA
  Anks1b
tgagagccccatcac

SEQ ID NO: 68257 - DNA, 15 bp, Artificial Sequence
  dgRNA
  Anks1b
gagccccatcacagg

SEQ ID NO: 68258 - DNA, 15 bp, Artificial Sequence
  dgRNA
  Akap13
gatcactttgccgcc

SEQ ID NO: 68259 - DNA, 15 bp, Artificial Sequence
  dgRNA
  Akap13
agaagccttcctatt

SEQ ID NO: 68260 - DNA, 15 bp, Artificial Sequence
  dgRNA
  Akap13
ttgcaccgcccaccc

SEQ ID NO: 68261 - DNA, 15 bp, Artificial Sequence
  dgRNA
  Akap13
tcaaagtcgggtggc

SEQ ID NO: 68262 - DNA, 15 bp, Artificial Sequence
  dgRNA
  Gimap1
ttctactaacccttc

SEQ ID NO: 68263 - DNA, 15 bp, Artificial Sequence
  dgRNA
  Gimap1
tgcgtgatttcatag

SEQ ID NO: 68264 - DNA, 15 bp, Artificial Sequence
  dgRNA
  Gimap1
gctgtttgtccagaa

SEQ ID NO: 68265 - DNA, 15 bp, Artificial Sequence
  dgRNA
  Gimap1
aaggccggatgatga

SEQ ID NO: 68266 - DNA, 15 bp, Artificial Sequence
  dgRNA
  Hand1
tggtaggttcagtac

SEQ ID NO: 68267 - DNA, 15 bp, Artificial Sequence
  dgRNA
  Hand1
ccccgcccttccagg

SEQ ID NO: 68268 - DNA, 15 bp, Artificial Sequence
  dgRNA
  Hand1
ccgcccttccaggag

SEQ ID NO: 68269 - DNA, 15 bp, Artificial Sequence
  dgRNA
  Hand1
gggacataggcgggg

SEQ ID NO: 68270 - DNA, 15 bp, Artificial Sequence
  dgRNA
  Ermap
gttgtcaccaagcac

SEQ ID NO: 68271 - DNA, 15 bp, Artificial Sequence
  dgRNA
  Ermap
gtcaccaagcactgg

SEQ ID NO: 68272 - DNA, 15 bp, Artificial Sequence
  dgRNA
  Ermap
ggtccttctttgccg

SEQ ID NO: 68273 - DNA, 15 bp, Artificial Sequence
  dgRNA
  Ermap
tgccgaggcagtaga

SEQ ID NO: 68274 - DNA, 15 bp, Artificial Sequence
  dgRNA
  Plvap
gggcggggcactcac

SEQ ID NO: 68275 - DNA, 15 bp, Artificial Sequence
  dgRNA
  Plvap
acaacactcccaccc

SEQ ID NO: 68276 - DNA, 15 bp, Artificial Sequence
  dgRNA
  Plvap
actgcgccaggcagg

SEQ ID NO: 68277 - DNA, 15 bp, Artificial Sequence
  dgRNA
  Pgm2
atagaccattggctc

SEQ ID NO: 68278 - DNA, 15 bp, Artificial Sequence
  dgRNA
  Pgm2
gagatgtgtcagtcg

SEQ ID NO: 68279 - DNA, 15 bp, Artificial Sequence
  dgRNA
  Pgm2
gcacgttactgtgat

SEQ ID NO: 68280 - DNA, 15 bp, Artificial Sequence
  dgRNA
  Pgm2
atcgatcatagtgca

SEQ ID NO: 68281 - DNA, 15 bp, Artificial Sequence
  dgRNA
  Sbno2
gttgcaagtgtgcca

SEQ ID NO: 68282 - DNA, 15 bp, Artificial Sequence
  dgRNA
  Sbno2
gtagcaagaactgcc

SEQ ID NO: 68283 - DNA, 15 bp, Artificial Sequence
  dgRNA
  Sbno2
ctgcccggccccaag

SEQ ID NO: 68284 - DNA, 15 bp, Artificial Sequence
  dgRNA
  Sbno2
gccccttcgcagaag

SEQ ID NO: 68285 - DNA, 15 bp, Artificial Sequence
  dgRNA
  Arpc2
agcgtaggactctcc

SEQ ID NO: 68286 - DNA, 15 bp, Artificial Sequence
  dgRNA
  Arpc2
aggactctcctggtc

SEQ ID NO: 68287 - DNA, 15 bp, Artificial Sequence
  dgRNA
  Arpc2
tggtcaggaggagcg

SEQ ID NO: 68288 - DNA, 15 bp, Artificial Sequence
  dgRNA
  Arpc2
accgggacgcgcttg

SEQ ID NO: 68289 - DNA, 15 bp, Artificial Sequence
  dgRNA
  Golga2
agaagccgtagcttc

SEQ ID NO: 68290 - DNA, 15 bp, Artificial Sequence
  dgRNA
  Golga2
ccggaagcagtttcg

SEQ ID NO: 68291 - DNA, 15 bp, Artificial Sequence
  dgRNA
  Golga2
gaagcagtttcgcgg

SEQ ID NO: 68292 - DNA, 15 bp, Artificial Sequence
  dgRNA
  Golga2
tttcgcggtggctgc

SEQ ID NO: 68293 - DNA, 15 bp, Artificial Sequence
  dgRNA
  Sorcs1
ggacacagcgcagct

SEQ ID NO: 68294 - DNA, 15 bp, Artificial Sequence
  dgRNA
  Sorcs1
agcgcagctcggaga

SEQ ID NO: 68295 - DNA, 15 bp, Artificial Sequence
  dgRNA
  Sorcs1
gcgcagctcggagac

SEQ ID NO: 68296 - DNA, 15 bp, Artificial Sequence
  dgRNA
  Sorcs1
cgggacgcagtgccc

SEQ ID NO: 68297 - DNA, 15 bp, Artificial Sequence
  dgRNA
  Ifng
tcgtcagagagccca

SEQ ID NO: 68298 - DNA, 15 bp, Artificial Sequence
  dgRNA
  Ifng
aaatacgtaatcccg

SEQ ID NO: 68299 - DNA, 15 bp, Artificial Sequence
  dgRNA
  Ifng
gaggagccttcgatc

SEQ ID NO: 68300 - DNA, 15 bp, Artificial Sequence
  dgRNA
  Ifng
gatcaggtataaaac

SEQ ID NO: 68301 - DNA, 15 bp, Artificial Sequence
  dgRNA
  Dnajb9
cgcttccgcacacct

SEQ ID NO: 68302 - DNA, 15 bp, Artificial Sequence
  dgRNA
  Dnajb9
cttggcaccgcccct

SEQ ID NO: 68303 - DNA, 15 bp, Artificial Sequence
  dgRNA
  Dnajb9
ggcaccgcccctcgg

SEQ ID NO: 68304 - DNA, 15 bp, Artificial Sequence
  dgRNA
  Dnajb9
gcaccgcccctcgga

SEQ ID NO: 68305 - DNA, 15 bp, Artificial Sequence
  dgRNA
  Rhox4f
tagctcacgtatgat

SEQ ID NO: 68306 - DNA, 15 bp, Artificial Sequence
  dgRNA
  Rhox4f
gtatgattggacact

SEQ ID NO: 68307 - DNA, 15 bp, Artificial Sequence
  dgRNA
  Olfr1136
aatgtggtatgatca

SEQ ID NO: 68308 - DNA, 15 bp, Artificial Sequence
  dgRNA
  Olfr1136
attatagttgtaatg

SEQ ID NO: 68309 - DNA, 15 bp, Artificial Sequence
  dgRNA
  Olfr1136
atctactaagtacac

SEQ ID NO: 68310 - DNA, 15 bp, Artificial Sequence
  dgRNA
  Rho
ggagacattgtcaac

SEQ ID NO: 68311 - DNA, 15 bp, Artificial Sequence
  dgRNA
  Rho
gaatttagggcccaa

SEQ ID NO: 68312 - DNA, 15 bp, Artificial Sequence
  dgRNA
  Rho
gcgactggaaccttt

SEQ ID NO: 68313 - DNA, 15 bp, Artificial Sequence
  dgRNA
  Rho
tgcgactggaacctt

SEQ ID NO: 68314 - DNA, 15 bp, Artificial Sequence
  dgRNA
  F7
cctcccggcagcatc

SEQ ID NO: 68315 - DNA, 15 bp, Artificial Sequence
  dgRNA
  F7
gagctcacccaccga

SEQ ID NO: 68316 - DNA, 15 bp, Artificial Sequence
  dgRNA
  F7
gtgggctcagaccgg

SEQ ID NO: 68317 - DNA, 15 bp, Artificial Sequence
  dgRNA
  F7
aatgtgggctcagac

SEQ ID NO: 68318 - DNA, 15 bp, Artificial Sequence
  dgRNA
  Nme4
ttccccctgcagtac

SEQ ID NO: 68319 - DNA, 15 bp, Artificial Sequence
  dgRNA
  Nme4
ggttggtcgagccca

SEQ ID NO: 68320 - DNA, 15 bp, Artificial Sequence
  dgRNA
  Nme4
cccagcgggcccctt

SEQ ID NO: 68321 - DNA, 15 bp, Artificial Sequence
  dgRNA
  Nme4
ccagcgggcccctta

SEQ ID NO: 68322 - DNA, 15 bp, Artificial Sequence
  dgRNA
  Inpp5b
aggcgttcctcacgc

SEQ ID NO: 68323 - DNA, 15 bp, Artificial Sequence
  dgRNA
  Inpp5b
aatagagtaagggcg

SEQ ID NO: 68324 - DNA, 15 bp, Artificial Sequence
  dgRNA
  Inpp5b
cgtccatgtccgact

SEQ ID NO: 68325 - DNA, 15 bp, Artificial Sequence
  dgRNA
  Inpp5b
gtccatgtccgactc

SEQ ID NO: 68326 - DNA, 15 bp, Artificial Sequence
  dgRNA
  Spg20
ggccggagggtgtgt

SEQ ID NO: 68327 - DNA, 15 bp, Artificial Sequence
  dgRNA
  Spg20
agagcgcgcaactgc

SEQ ID NO: 68328 - DNA, 15 bp, Artificial Sequence
  dgRNA
  Olfr1233
agttgaaagtgagta

SEQ ID NO: 68329 - DNA, 15 bp, Artificial Sequence
  dgRNA
  Olfr1233
gggagcgctgaagtg

SEQ ID NO: 68330 - DNA, 15 bp, Artificial Sequence
  dgRNA
  Crisp4
gaggccccttagcta

SEQ ID NO: 68331 - DNA, 15 bp, Artificial Sequence
  dgRNA
  Crisp4
gtaaaaccttgctca

SEQ ID NO: 68332 - DNA, 15 bp, Artificial Sequence
  dgRNA
  Crisp4
ttaagccttagctaa

SEQ ID NO: 68333 - DNA, 15 bp, Artificial Sequence
  dgRNA
  Crisp4
attaagccttagcta

SEQ ID NO: 68334 - DNA, 15 bp, Artificial Sequence
  dgRNA
  Prr29
aggggtaaggtagtc

SEQ ID NO: 68335 - DNA, 15 bp, Artificial Sequence
  dgRNA
  Prr29
tgggaaaccccatac

SEQ ID NO: 68336 - DNA, 15 bp, Artificial Sequence
  dgRNA
  Prr29
gggaaaccccataca

SEQ ID NO: 68337 - DNA, 15 bp, Artificial Sequence
  dgRNA
  Prr29
ggaaaccccatacag

SEQ ID NO: 68338 - DNA, 15 bp, Artificial Sequence
  dgRNA
  Eif4g2
cttatcactctgagg

SEQ ID NO: 68339 - DNA, 15 bp, Artificial Sequence
  dgRNA
  Mfsd6l
cgcccagcaaaccac

SEQ ID NO: 68340 - DNA, 15 bp, Artificial Sequence
  dgRNA
  Mfsd6l
cgtccgtcatccatt

SEQ ID NO: 68341 - DNA, 15 bp, Artificial Sequence
  dgRNA
  Mfsd6l
ccgtcatccattagg

SEQ ID NO: 68342 - DNA, 15 bp, Artificial Sequence
  dgRNA
  Mfsd6l
tccattaggtggcgc

SEQ ID NO: 68343 - DNA, 15 bp, Artificial Sequence
  dgRNA
  Plppr2
gtgttatgcaaatta

SEQ ID NO: 68344 - DNA, 15 bp, Artificial Sequence
  dgRNA
  Plppr2
atggccccgcctgcc

SEQ ID NO: 68345 - DNA, 15 bp, Artificial Sequence
  dgRNA
  Plppr2
ggctaacaagaggct

SEQ ID NO: 68346 - DNA, 15 bp, Artificial Sequence
  dgRNA
  Plppr2
gctaacaagaggctt

SEQ ID NO: 68347 - DNA, 15 bp, Artificial Sequence
  dgRNA
  Maob
tggggacggactttc

SEQ ID NO: 68348 - DNA, 15 bp, Artificial Sequence
  dgRNA
  Maob
ctgtgttgtcgggct

SEQ ID NO: 68349 - DNA, 15 bp, Artificial Sequence
  dgRNA
  Maob
tgtgttgtcgggctg

SEQ ID NO: 68350 - DNA, 15 bp, Artificial Sequence
  dgRNA
  Maob
gtgttgtcgggctgg

SEQ ID NO: 68351 - DNA, 15 bp, Artificial Sequence
  dgRNA
  Osbpl7
ggaactatgcccagt

SEQ ID NO: 68352 - DNA, 15 bp, Artificial Sequence
  dgRNA
  Osbpl7
gtcctcccgagagca

SEQ ID NO: 68353 - DNA, 15 bp, Artificial Sequence
  dgRNA
  Osbpl7
cctcccgagagcagg

SEQ ID NO: 68354 - DNA, 15 bp, Artificial Sequence
  dgRNA
  Osbpl7
cggcagcccggagct

SEQ ID NO: 68355 - DNA, 15 bp, Artificial Sequence
  dgRNA
  Prdm9
ggagggtcggtgcct

SEQ ID NO: 68356 - DNA, 15 bp, Artificial Sequence
  dgRNA
  Prdm9
tcggtgcctaggttt

SEQ ID NO: 68357 - DNA, 15 bp, Artificial Sequence
  dgRNA
  Prdm9
cggtgcctaggttta

SEQ ID NO: 68358 - DNA, 15 bp, Artificial Sequence
  dgRNA
  Prdm9
cagagtactagacct

SEQ ID NO: 68359 - DNA, 15 bp, Artificial Sequence
  dgRNA
  Taok3
aacaggaagtagcgc

SEQ ID NO: 68360 - DNA, 15 bp, Artificial Sequence
  dgRNA
  Proser2
acaagtagaccgaga

SEQ ID NO: 68361 - DNA, 15 bp, Artificial Sequence
  dgRNA
  Proser2
ccgagaaggcctgac

SEQ ID NO: 68362 - DNA, 15 bp, Artificial Sequence
  dgRNA
  Proser2
aagggctttgggcgc

SEQ ID NO: 68363 - DNA, 15 bp, Artificial Sequence
  dgRNA
  Proser2
gccctttaagtatcg

SEQ ID NO: 68364 - DNA, 15 bp, Artificial Sequence
  dgRNA
  Atp5l
atctaggtttttact

SEQ ID NO: 68365 - DNA, 15 bp, Artificial Sequence
  dgRNA
  Atp5l
gttggtccggaagat

SEQ ID NO: 68366 - DNA, 15 bp, Artificial Sequence
  dgRNA
  Atp5l
ctattcatgttggtc

SEQ ID NO: 68367 - DNA, 15 bp, Artificial Sequence
  dgRNA
  Atp5l
gacagctattcatgt

SEQ ID NO: 68368 - DNA, 15 bp, Artificial Sequence
  dgRNA
  Dcpp3
gctatagtgccaagt

SEQ ID NO: 68369 - DNA, 15 bp, Artificial Sequence
  dgRNA
  Dcpp3
tagcctacgtcaaca

SEQ ID NO: 68370 - DNA, 15 bp, Artificial Sequence
  dgRNA
  Dcpp3
atagcctacgtcaac

SEQ ID NO: 68371 - DNA, 15 bp, Artificial Sequence
  dgRNA
  Bmp3
ctacccttctggttc

SEQ ID NO: 68372 - DNA, 15 bp, Artificial Sequence
  dgRNA
  CR936839.1
gggtacttgccatgc

SEQ ID NO: 68373 - DNA, 15 bp, Artificial Sequence
  dgRNA
  CR936839.1
tacttgccatgcagg

SEQ ID NO: 68374 - DNA, 15 bp, Artificial Sequence
  dgRNA
  CR936839.1
ccggtgatgtatgaa

SEQ ID NO: 68375 - DNA, 15 bp, Artificial Sequence
  dgRNA
  Uba2
accgaggtctttaga

SEQ ID NO: 68376 - DNA, 15 bp, Artificial Sequence
  dgRNA
  Uba2
ttagaaggtgaccct

SEQ ID NO: 68377 - DNA, 15 bp, Artificial Sequence
  dgRNA
  Uba2
gtgagaagtaatccc

SEQ ID NO: 68378 - DNA, 15 bp, Artificial Sequence
  dgRNA
  Uba2
cgcctgagcccatcc

SEQ ID NO: 68379 - DNA, 15 bp, Artificial Sequence
  dgRNA
  Alk
cgcctccttgtagct

SEQ ID NO: 68380 - DNA, 15 bp, Artificial Sequence
  dgRNA
  Alk
gtccctgagatctag

SEQ ID NO: 68381 - DNA, 15 bp, Artificial Sequence
  dgRNA
  Alk
ggaccaaggactatt

SEQ ID NO: 68382 - DNA, 15 bp, Artificial Sequence
  dgRNA
  Alk
tacaaggaggcgaga

SEQ ID NO: 68383 - DNA, 15 bp, Artificial Sequence
  dgRNA
  D430041D05Rik
tagagacctgggcgc

SEQ ID NO: 68384 - DNA, 15 bp, Artificial Sequence
  dgRNA
  D430041D05Rik
cacgctgcacgagct

SEQ ID NO: 68385 - DNA, 15 bp, Artificial Sequence
  dgRNA
  D430041D05Rik
cacgagctaggtccg

SEQ ID NO: 68386 - DNA, 15 bp, Artificial Sequence
  dgRNA
  D430041D05Rik
acgagctaggtccgc

SEQ ID NO: 68387 - DNA, 15 bp, Artificial Sequence
  dgRNA
  Stx12
ccgtctgtagacgac

SEQ ID NO: 68388 - DNA, 15 bp, Artificial Sequence
  dgRNA
  Stx12
agtccggtcctgtac

SEQ ID NO: 68389 - DNA, 15 bp, Artificial Sequence
  dgRNA
  Stx12
gcacacgcgcactgc

SEQ ID NO: 68390 - DNA, 15 bp, Artificial Sequence
  dgRNA
  Stx12
acgcgcactgcagga

SEQ ID NO: 68391 - DNA, 15 bp, Artificial Sequence
  dgRNA
  Sv2c
cactgcagcaccgaa

SEQ ID NO: 68392 - DNA, 15 bp, Artificial Sequence
  dgRNA
  Sv2c
tgcagcaccgaaggg

SEQ ID NO: 68393 - DNA, 15 bp, Artificial Sequence
  dgRNA
  Sv2c
agcaccgaagggagg

SEQ ID NO: 68394 - DNA, 15 bp, Artificial Sequence
  dgRNA
  Sv2c
aggaggaccgcagcg

SEQ ID NO: 68395 - DNA, 15 bp, Artificial Sequence
  dgRNA
  Ubl4b
cataatgctacagga

SEQ ID NO: 68396 - DNA, 15 bp, Artificial Sequence
  dgRNA
  Ubl4b
tcataatgctacagg

SEQ ID NO: 68397 - DNA, 15 bp, Artificial Sequence
  dgRNA
  Ubl4b
atgtcataatgctac

SEQ ID NO: 68398 - DNA, 15 bp, Artificial Sequence
  dgRNA
  Smarcd3
cttctgtgcgccgct

SEQ ID NO: 68399 - DNA, 15 bp, Artificial Sequence
  dgRNA
  Smarcd3
gccgcttggaccacg

SEQ ID NO: 68400 - DNA, 15 bp, Artificial Sequence
  dgRNA
  Smarcd3
ccacgcggagtgcac

SEQ ID NO: 68401 - DNA, 15 bp, Artificial Sequence
  dgRNA
  Smarcd3
cgcggagtgcacagg

SEQ ID NO: 68402 - DNA, 15 bp, Artificial Sequence
  dgRNA
  Myt1l
gaaggtcatatgccg

SEQ ID NO: 68403 - DNA, 15 bp, Artificial Sequence
  dgRNA
  Myt1l
catatgccggggatt

SEQ ID NO: 68404 - DNA, 15 bp, Artificial Sequence
  dgRNA
  Myt1l
atgtctctcacaagg

SEQ ID NO: 68405 - DNA, 15 bp, Artificial Sequence
  dgRNA
  Myt1l
cgagctccaaatccc

SEQ ID NO: 68406 - DNA, 15 bp, Artificial Sequence
  dgRNA
  Dock5
ctcctccgcgctcgg

SEQ ID NO: 68407 - DNA, 15 bp, Artificial Sequence
  dgRNA
  Dock5
gcggcgcagcagccc

SEQ ID NO: 68408 - DNA, 15 bp, Artificial Sequence
  dgRNA
  Dock5
tcgcagagccgacgc

SEQ ID NO: 68409 - DNA, 15 bp, Artificial Sequence
  dgRNA
  Dock5
agagccgacgctggg

SEQ ID NO: 68410 - DNA, 15 bp, Artificial Sequence
  dgRNA
  Slc10a6
gtgccactgtcgaca

SEQ ID NO: 68411 - DNA, 15 bp, Artificial Sequence
  dgRNA
  Slc10a6
ctgtcgacatgggcc

SEQ ID NO: 68412 - DNA, 15 bp, Artificial Sequence
  dgRNA
  Slc10a6
gcattgaacgctcag

SEQ ID NO: 68413 - DNA, 15 bp, Artificial Sequence
  dgRNA
  Slc10a6
ctagcgaaattagag

SEQ ID NO: 68414 - DNA, 15 bp, Artificial Sequence
  dgRNA
  Greb1
agcggggacgggacg

SEQ ID NO: 68415 - DNA, 15 bp, Artificial Sequence
  dgRNA
  Greb1
tcctgtgcctacacc

SEQ ID NO: 68416 - DNA, 15 bp, Artificial Sequence
  dgRNA
  Greb1
gtgcctacacctgga

SEQ ID NO: 68417 - DNA, 15 bp, Artificial Sequence
  dgRNA
  Greb1
gccccccaatcacgg

SEQ ID NO: 68418 - DNA, 15 bp, Artificial Sequence
  dgRNA
  Pcyt2
ctgcacgcacagttg

SEQ ID NO: 68419 - DNA, 15 bp, Artificial Sequence
  dgRNA
  Pcyt2
tgccccgttcgtctg

SEQ ID NO: 68420 - DNA, 15 bp, Artificial Sequence
  dgRNA
  Pcyt2
tgcaacacagaccat

SEQ ID NO: 68421 - DNA, 15 bp, Artificial Sequence
  dgRNA
  Pcyt2
attggccgctcgatc

SEQ ID NO: 68422 - DNA, 15 bp, Artificial Sequence
  dgRNA
  Clasrp
acaacaaaacgtgtc

SEQ ID NO: 68423 - DNA, 15 bp, Artificial Sequence
  dgRNA
  Clasrp
acgtgtctggaattc

SEQ ID NO: 68424 - DNA, 15 bp, Artificial Sequence
  dgRNA
  Clasrp
cgtgtctggaattct

SEQ ID NO: 68425 - DNA, 15 bp, Artificial Sequence
  dgRNA
  Clasrp
tctcacttttaggac

SEQ ID NO: 68426 - DNA, 15 bp, Artificial Sequence
  dgRNA
  Btnl10
tatgctcagtacagc

SEQ ID NO: 68427 - DNA, 15 bp, Artificial Sequence
  dgRNA
  Btnl10
gccatatgcccctta

SEQ ID NO: 68428 - DNA, 15 bp, Artificial Sequence
  dgRNA
  Btnl10
atatgccccttaggg

SEQ ID NO: 68429 - DNA, 15 bp, Artificial Sequence
  dgRNA
  Btnl10
tatgccccttaggga

SEQ ID NO: 68430 - DNA, 15 bp, Artificial Sequence
  dgRNA
  Adam12
cccggagcggtctct

SEQ ID NO: 68431 - DNA, 15 bp, Artificial Sequence
  dgRNA
  Adam12
ggtctctaggacccg

SEQ ID NO: 68432 - DNA, 15 bp, Artificial Sequence
  dgRNA
  Adam12
gtctctaggacccgc

SEQ ID NO: 68433 - DNA, 15 bp, Artificial Sequence
  dgRNA
  Adam12
cccgcgggacgccgc

SEQ ID NO: 68434 - DNA, 15 bp, Artificial Sequence
  dgRNA
  Ttf2
tgccggcgtcctcac

SEQ ID NO: 68435 - DNA, 15 bp, Artificial Sequence
  dgRNA
  Ttf2
agcgcgccaagcctg

SEQ ID NO: 68436 - DNA, 15 bp, Artificial Sequence
  dgRNA
  Ttf2
gcgcgccaagcctga

SEQ ID NO: 68437 - DNA, 15 bp, Artificial Sequence
  dgRNA
  Ttf2
actctcccgcttgat

SEQ ID NO: 68438 - DNA, 15 bp, Artificial Sequence
  dgRNA
  Atrnl1
tagcaggagtaccgc

SEQ ID NO: 68439 - DNA, 15 bp, Artificial Sequence
  dgRNA
  Atrnl1
agcaggagtaccgcc

SEQ ID NO: 68440 - DNA, 15 bp, Artificial Sequence
  dgRNA
  Atrnl1
cccgcgtgctcctgt

SEQ ID NO: 68441 - DNA, 15 bp, Artificial Sequence
  dgRNA
  Atrnl1
tggacgcgcccatct

SEQ ID NO: 68442 - DNA, 15 bp, Artificial Sequence
  dgRNA
  Mnx1
cttcaagtgtgcgga

SEQ ID NO: 68443 - DNA, 15 bp, Artificial Sequence
  dgRNA
  Mnx1
ttcaagtgtgcggag

SEQ ID NO: 68444 - DNA, 15 bp, Artificial Sequence
  dgRNA
  Mnx1
tgtgcggaggggcgc

SEQ ID NO: 68445 - DNA, 15 bp, Artificial Sequence
  dgRNA
  Mnx1
cgcgggtccccacca

SEQ ID NO: 68446 - DNA, 15 bp, Artificial Sequence
  dgRNA
  Ddx60
taagcaaggcaacat

SEQ ID NO: 68447 - DNA, 15 bp, Artificial Sequence
  dgRNA
  Ddx60
attcttgaggtaagg

SEQ ID NO: 68448 - DNA, 15 bp, Artificial Sequence
  dgRNA
  Ddx60
tagtactgttaaggt

SEQ ID NO: 68449 - DNA, 15 bp, Artificial Sequence
  dgRNA
  Ddx60
aagttagtactgtta

SEQ ID NO: 68450 - DNA, 15 bp, Artificial Sequence
  dgRNA
  Tmem53
aaggtaagagtcggt

SEQ ID NO: 68451 - DNA, 15 bp, Artificial Sequence
  dgRNA
  Tmem53
cgcaccctcctgtga

SEQ ID NO: 68452 - DNA, 15 bp, Artificial Sequence
  dgRNA
  Tmem53
gtggggcagcgctct

SEQ ID NO: 68453 - DNA, 15 bp, Artificial Sequence
  dgRNA
  Tmem53
aagtattggtcagtg

SEQ ID NO: 68454 - DNA, 15 bp, Artificial Sequence
  dgRNA
  Snrpd1
taataacttcgtaac

SEQ ID NO: 68455 - DNA, 15 bp, Artificial Sequence
  dgRNA
  Snrpd1
cctcccgccctccga

SEQ ID NO: 68456 - DNA, 15 bp, Artificial Sequence
  dgRNA
  Snrpd1
actcctcccgtcgct

SEQ ID NO: 68457 - DNA, 15 bp, Artificial Sequence
  dgRNA
  Snrpd1
ctcctcccgtcgcta

SEQ ID NO: 68458 - DNA, 15 bp, Artificial Sequence
  dgRNA
  Ikbkg
ggcctagctttccgc

SEQ ID NO: 68459 - DNA, 15 bp, Artificial Sequence
  dgRNA
  Ikbkg
tccgctggaccttcg

SEQ ID NO: 68460 - DNA, 15 bp, Artificial Sequence
  dgRNA
  Ikbkg
ccctagctgctagtt

SEQ ID NO: 68461 - DNA, 15 bp, Artificial Sequence
  dgRNA
  Ikbkg
gtttggcttcggagc

SEQ ID NO: 68462 - DNA, 15 bp, Artificial Sequence
  dgRNA
  Misp
tctgcttttgacgtg

SEQ ID NO: 68463 - DNA, 15 bp, Artificial Sequence
  dgRNA
  Misp
ttttgacgtgtggca

SEQ ID NO: 68464 - DNA, 15 bp, Artificial Sequence
  dgRNA
  Misp
gggtttcacctgggc

SEQ ID NO: 68465 - DNA, 15 bp, Artificial Sequence
  dgRNA
  Misp
ttcacctgggcggga

SEQ ID NO: 68466 - DNA, 15 bp, Artificial Sequence
  dgRNA
  Akap7
acatgttacttcacc

SEQ ID NO: 68467 - DNA, 15 bp, Artificial Sequence
  dgRNA
  Akap7
tctccgtaggactct

SEQ ID NO: 68468 - DNA, 15 bp, Artificial Sequence
  dgRNA
  Akap7
atctccgtaggactc

SEQ ID NO: 68469 - DNA, 15 bp, Artificial Sequence
  dgRNA
  Akap7
agacggcatctccgt

SEQ ID NO: 68470 - DNA, 15 bp, Artificial Sequence
  dgRNA
  Zfp575
gctaggatccttagg

SEQ ID NO: 68471 - DNA, 15 bp, Artificial Sequence
  dgRNA
  Zfp575
cactaacttgccagc

SEQ ID NO: 68472 - DNA, 15 bp, Artificial Sequence
  dgRNA
  Zfp575
actaacttgccagct

SEQ ID NO: 68473 - DNA, 15 bp, Artificial Sequence
  dgRNA
  Zfp575
aacttgccagctggg

SEQ ID NO: 68474 - DNA, 15 bp, Artificial Sequence
  dgRNA
  Alpi
ggtgactatatctag

SEQ ID NO: 68475 - DNA, 15 bp, Artificial Sequence
  dgRNA
  Alpi
ggaccctttatagcc

SEQ ID NO: 68476 - DNA, 15 bp, Artificial Sequence
  dgRNA
  Alpi
ctctcaaggtgtggc

SEQ ID NO: 68477 - DNA, 15 bp, Artificial Sequence
  dgRNA
  Alpi
tagatatagtcaccc

SEQ ID NO: 68478 - DNA, 15 bp, Artificial Sequence
  dgRNA
  Cldn5
ctgcagggtgcggtt

SEQ ID NO: 68479 - DNA, 15 bp, Artificial Sequence
  dgRNA
  Cldn5
tgcagggtgcggttc

SEQ ID NO: 68480 - DNA, 15 bp, Artificial Sequence
  dgRNA
  Cldn5
gcggttcgggtgagc

SEQ ID NO: 68481 - DNA, 15 bp, Artificial Sequence
  dgRNA
  Cldn5
agtcctgctcgcccg

SEQ ID NO: 68482 - DNA, 15 bp, Artificial Sequence
  dgRNA
  Dpm3
cttaacgcagcgttt

SEQ ID NO: 68483 - DNA, 15 bp, Artificial Sequence
  dgRNA
  Dpm3
ttaacgcagcgtttc

SEQ ID NO: 68484 - DNA, 15 bp, Artificial Sequence
  dgRNA
  Dpm3
taacgcagcgtttcg

SEQ ID NO: 68485 - DNA, 15 bp, Artificial Sequence
  dgRNA
  Dpm3
cagccggtatcgatg

SEQ ID NO: 68486 - DNA, 15 bp, Artificial Sequence
  dgRNA
  Secisbp2
cagccgcgcccttcc

SEQ ID NO: 68487 - DNA, 15 bp, Artificial Sequence
  dgRNA
  Secisbp2
ccagtcttccacgtg

SEQ ID NO: 68488 - DNA, 15 bp, Artificial Sequence
  dgRNA
  Secisbp2
ttccacgtgcggctc

SEQ ID NO: 68489 - DNA, 15 bp, Artificial Sequence
  dgRNA
  Secisbp2
cacgtgcggctccgg

SEQ ID NO: 68490 - DNA, 15 bp, Artificial Sequence
  dgRNA
  Osgepl1
aaatgcggcatagtg

SEQ ID NO: 68491 - DNA, 15 bp, Artificial Sequence
  dgRNA
  Osgepl1
aatgcggcatagtgt

SEQ ID NO: 68492 - DNA, 15 bp, Artificial Sequence
  dgRNA
  Osgepl1
gagatctactgaatc

SEQ ID NO: 68493 - DNA, 15 bp, Artificial Sequence
  dgRNA
  Osgepl1
tggtattcacaaacc

SEQ ID NO: 68494 - DNA, 15 bp, Artificial Sequence
  dgRNA
  Zfp212
tcttaaagcatttcg

SEQ ID NO: 68495 - DNA, 15 bp, Artificial Sequence
  dgRNA
  Zfp212
catttcgcggagtgc

SEQ ID NO: 68496 - DNA, 15 bp, Artificial Sequence
  dgRNA
  Zfp212
gaacaccatacgttc

SEQ ID NO: 68497 - DNA, 15 bp, Artificial Sequence
  dgRNA
  Zfp212
gactagtagaaaagg

SEQ ID NO: 68498 - DNA, 15 bp, Artificial Sequence
  dgRNA
  Rcn3
ttccccttaatcccc

SEQ ID NO: 68499 - DNA, 15 bp, Artificial Sequence
  dgRNA
  Rcn3
ccccttaatcccctg

SEQ ID NO: 68500 - DNA, 15 bp, Artificial Sequence
  dgRNA
  Rcn3
ggtggtcgtgcaagt

SEQ ID NO: 68501 - DNA, 15 bp, Artificial Sequence
  dgRNA
  Rcn3
ggcccatatgtttgc

SEQ ID NO: 68502 - DNA, 15 bp, Artificial Sequence
  dgRNA
  Srrm2
ccccgcagtgcccga

SEQ ID NO: 68503 - DNA, 15 bp, Artificial Sequence
  dgRNA
  Srrm2
cccgcagtgcccgac

SEQ ID NO: 68504 - DNA, 15 bp, Artificial Sequence
  dgRNA
  Srrm2
gtgcccgacgggact

SEQ ID NO: 68505 - DNA, 15 bp, Artificial Sequence
  dgRNA
  Srrm2
tgcccgacgggactc

SEQ ID NO: 68506 - DNA, 15 bp, Artificial Sequence
  dgRNA
  Gpc2
ccagcctccgccgtg

SEQ ID NO: 68507 - DNA, 15 bp, Artificial Sequence
  dgRNA
  Gpc2
gttgccgttccacat

SEQ ID NO: 68508 - DNA, 15 bp, Artificial Sequence
  dgRNA
  Gpc2
cttcttatcattggc

SEQ ID NO: 68509 - DNA, 15 bp, Artificial Sequence
  dgRNA
  Gpc2
ggcgggctaccgctt

SEQ ID NO: 68510 - DNA, 15 bp, Artificial Sequence
  dgRNA
  Pdzk1
taggaccctgccagc

SEQ ID NO: 68511 - DNA, 15 bp, Artificial Sequence
  dgRNA
  Pdzk1
agcctaacaatggga

SEQ ID NO: 68512 - DNA, 15 bp, Artificial Sequence
  dgRNA
  Pdzk1
ccccagcctaacaat

SEQ ID NO: 68513 - DNA, 15 bp, Artificial Sequence
  dgRNA
  Pdzk1
accccagcctaacaa

SEQ ID NO: 68514 - DNA, 15 bp, Artificial Sequence
  dgRNA
  Bahd1
acccacgattctgat

SEQ ID NO: 68515 - DNA, 15 bp, Artificial Sequence
  dgRNA
  Bahd1
acgattctgattggt

SEQ ID NO: 68516 - DNA, 15 bp, Artificial Sequence
  dgRNA
  Bahd1
gattggttggagacc

SEQ ID NO: 68517 - DNA, 15 bp, Artificial Sequence
  dgRNA
  Bahd1
tggttggagaccggg

SEQ ID NO: 68518 - DNA, 15 bp, Artificial Sequence
  dgRNA
  Homer2
tgagtttagttaagg

SEQ ID NO: 68519 - DNA, 15 bp, Artificial Sequence
  dgRNA
  Homer2
ttagttaagggggaa

SEQ ID NO: 68520 - DNA, 15 bp, Artificial Sequence
  dgRNA
  Homer2
ttgaataaggacagc

SEQ ID NO: 68521 - DNA, 15 bp, Artificial Sequence
  dgRNA
  Homer2
ggtactgattgatcc

SEQ ID NO: 68522 - DNA, 15 bp, Artificial Sequence
  dgRNA
  Ppt2
tagccggatggggag

SEQ ID NO: 68523 - DNA, 15 bp, Artificial Sequence
  dgRNA
  Lcn8
cacatgctaggatgg

SEQ ID NO: 68524 - DNA, 15 bp, Artificial Sequence
  dgRNA
  Lcn8
ggtcctacacctctc

SEQ ID NO: 68525 - DNA, 15 bp, Artificial Sequence
  dgRNA
  Lcn8
ctacacctctctgga

SEQ ID NO: 68526 - DNA, 15 bp, Artificial Sequence
  dgRNA
  Lcn8
tacacctctctggat

SEQ ID NO: 68527 - DNA, 15 bp, Artificial Sequence
  dgRNA
  Mrpl17
caagagaaacccggc

SEQ ID NO: 68528 - DNA, 15 bp, Artificial Sequence
  dgRNA
  Mrpl17
aagagaaacccggca

SEQ ID NO: 68529 - DNA, 15 bp, Artificial Sequence
  dgRNA
  Mrpl17
gagaaacccggcagg

SEQ ID NO: 68530 - DNA, 15 bp, Artificial Sequence
  dgRNA
  Mrpl17
gcaccgcagaccttg

SEQ ID NO: 68531 - DNA, 15 bp, Artificial Sequence
  dgRNA
  Olfr478
attacagcattgatc

SEQ ID NO: 68532 - DNA, 15 bp, Artificial Sequence
  dgRNA
  Olfr478
agatcaatgctgtaa

SEQ ID NO: 68533 - DNA, 15 bp, Artificial Sequence
  dgRNA
  Olfr623
tatctagaaggtccc

SEQ ID NO: 68534 - DNA, 15 bp, Artificial Sequence
  dgRNA
  Olfr623
gaacatccacacagc

SEQ ID NO: 68535 - DNA, 15 bp, Artificial Sequence
  dgRNA
  Olfr623
ggtagcatcttcaca

SEQ ID NO: 68536 - DNA, 15 bp, Artificial Sequence
  dgRNA
  Olfr623
acaaggcaaacccta

SEQ ID NO: 68537 - DNA, 15 bp, Artificial Sequence
  dgRNA
  Cd1d2
aagtaccagggggtt

SEQ ID NO: 68538 - DNA, 15 bp, Artificial Sequence
  dgRNA
  Cd1d2
gcgtccttccgggtt

SEQ ID NO: 68539 - DNA, 15 bp, Artificial Sequence
  dgRNA
  Cd1d2
ccttccgggttaggc

SEQ ID NO: 68540 - DNA, 15 bp, Artificial Sequence
  dgRNA
  Cd1d2
cctgcctaacccgga

SEQ ID NO: 68541 - DNA, 15 bp, Artificial Sequence
  dgRNA
  Ccdc88b
ggttcctgactccat

SEQ ID NO: 68542 - DNA, 15 bp, Artificial Sequence
  dgRNA
  Ccdc88b
tgtaagttagctgag

SEQ ID NO: 68543 - DNA, 15 bp, Artificial Sequence
  dgRNA
  Ccdc88b
ttccggggttctgca

SEQ ID NO: 68544 - DNA, 15 bp, Artificial Sequence
  dgRNA
  Ccdc88b
cttccggggttctgc

SEQ ID NO: 68545 - DNA, 15 bp, Artificial Sequence
  dgRNA
  1700102P08Rik
agaccctctccagac

SEQ ID NO: 68546 - DNA, 15 bp, Artificial Sequence
  dgRNA
  1700102P08Rik
cccttactcccctag

SEQ ID NO: 68547 - DNA, 15 bp, Artificial Sequence
  dgRNA
  1700102P08Rik
ccctagtggcaaagc

SEQ ID NO: 68548 - DNA, 15 bp, Artificial Sequence
  dgRNA
  1700102P08Rik
agccggcaacctaac

SEQ ID NO: 68549 - DNA, 15 bp, Artificial Sequence
  dgRNA
  Med25
ttcgcttccaagtcc

SEQ ID NO: 68550 - DNA, 15 bp, Artificial Sequence
  dgRNA
  Med25
tcgcttccaagtccc

SEQ ID NO: 68551 - DNA, 15 bp, Artificial Sequence
  dgRNA
  Med25
ttccaatgatgtgat

SEQ ID NO: 68552 - DNA, 15 bp, Artificial Sequence
  dgRNA
  Med25
accgctctctttcat

SEQ ID NO: 68553 - DNA, 15 bp, Artificial Sequence
  dgRNA
  Rnf138rt1
taaagtaagcggacc

SEQ ID NO: 68554 - DNA, 15 bp, Artificial Sequence
  dgRNA
  Rnf138rt1
gtcacaaccagctga

SEQ ID NO: 68555 - DNA, 15 bp, Artificial Sequence
  dgRNA
  Rnf138rt1
gaaggcgcgacgcgc

SEQ ID NO: 68556 - DNA, 15 bp, Artificial Sequence
  dgRNA
  Rnf138rt1
acgcgctggttgcta

SEQ ID NO: 68557 - DNA, 15 bp, Artificial Sequence
  dgRNA
  Ppm1f
agtgtagcaacgcac

SEQ ID NO: 68558 - DNA, 15 bp, Artificial Sequence
  dgRNA
  Ppm1f
caacgcactggctat

SEQ ID NO: 68559 - DNA, 15 bp, Artificial Sequence
  dgRNA
  Ppm1f
aacgcactggctatt

SEQ ID NO: 68560 - DNA, 15 bp, Artificial Sequence
  dgRNA
  Ppm1f
acgcactggctattg

SEQ ID NO: 68561 - DNA, 15 bp, Artificial Sequence
  dgRNA
  Zfp641
agcagcaaagcccgt

SEQ ID NO: 68562 - DNA, 15 bp, Artificial Sequence
  dgRNA
  Zfp641
gtgggctgtggcgac

SEQ ID NO: 68563 - DNA, 15 bp, Artificial Sequence
  dgRNA
  Zfp641
cgcaccacggagccc

SEQ ID NO: 68564 - DNA, 15 bp, Artificial Sequence
  dgRNA
  Zfp641
gagccccggaagcgg

SEQ ID NO: 68565 - DNA, 15 bp, Artificial Sequence
  dgRNA
  Slc22a20
tttaggcctcctgtg

SEQ ID NO: 68566 - DNA, 15 bp, Artificial Sequence
  dgRNA
  Slc22a20
tgggcaggcccgacc

SEQ ID NO: 68567 - DNA, 15 bp, Artificial Sequence
  dgRNA
  Slc22a20
gggcaggcccgacct

SEQ ID NO: 68568 - DNA, 15 bp, Artificial Sequence
  dgRNA
  Slc22a20
ggcaggcccgacctg

SEQ ID NO: 68569 - DNA, 15 bp, Artificial Sequence
  dgRNA
  Ctsm
tgacaggcacccctt

SEQ ID NO: 68570 - DNA, 15 bp, Artificial Sequence
  dgRNA
  Ctsm
gacaggcaccccttc

SEQ ID NO: 68571 - DNA, 15 bp, Artificial Sequence
  dgRNA
  Ctsm
ctacttgtcccgaag

SEQ ID NO: 68572 - DNA, 15 bp, Artificial Sequence
  dgRNA
  Ctsm
gctacttgtcccgaa

SEQ ID NO: 68573 - DNA, 15 bp, Artificial Sequence
  dgRNA
  Dnaja4
ctccggggagtcgga

SEQ ID NO: 68574 - DNA, 15 bp, Artificial Sequence
  dgRNA
  Dnaja4
cggacggccagccag

SEQ ID NO: 68575 - DNA, 15 bp, Artificial Sequence
  dgRNA
  Dnaja4
gtgagcgcgcgcgcc

SEQ ID NO: 68576 - DNA, 15 bp, Artificial Sequence
  dgRNA
  Dnaja4
cggaggaccgagccc

SEQ ID NO: 68577 - DNA, 15 bp, Artificial Sequence
  dgRNA
  0610010F05Rik
ggctctgtgcagcgg

SEQ ID NO: 68578 - DNA, 15 bp, Artificial Sequence
  dgRNA
  0610010F05Rik
gctctgtgcagcggt

SEQ ID NO: 68579 - DNA, 15 bp, Artificial Sequence
  dgRNA
  0610010F05Rik
cggtgggctgcactc

SEQ ID NO: 68580 - DNA, 15 bp, Artificial Sequence
  dgRNA
  0610010F05Rik
gatctcgtcgctcat

SEQ ID NO: 68581 - DNA, 15 bp, Artificial Sequence
  dgRNA
  Rin2
tcacagcagattatg

SEQ ID NO: 68582 - DNA, 15 bp, Artificial Sequence
  dgRNA
  Rin2
ggggacaactaatat

SEQ ID NO: 68583 - DNA, 15 bp, Artificial Sequence
  dgRNA
  Rin2
ttttggacttcagct

SEQ ID NO: 68584 - DNA, 15 bp, Artificial Sequence
  dgRNA
  Rin2
cagatcgcagaagaa

SEQ ID NO: 68585 - DNA, 15 bp, Artificial Sequence
  dgRNA
  Krtap6-1
attagtcaatagcat

SEQ ID NO: 68586 - DNA, 15 bp, Artificial Sequence
  dgRNA
  Krtap6-1
cttcgcagccattaa

SEQ ID NO: 68587 - DNA, 15 bp, Artificial Sequence
  dgRNA
  Lyrm1
cagcggtccgcccgg

SEQ ID NO: 68588 - DNA, 15 bp, Artificial Sequence
  dgRNA
  Lyrm1
gtccgcccggtggtt

SEQ ID NO: 68589 - DNA, 15 bp, Artificial Sequence
  dgRNA
  Lyrm1
tggtttggcccggcc

SEQ ID NO: 68590 - DNA, 15 bp, Artificial Sequence
  dgRNA
  Lyrm1
cccggcctggcctac

SEQ ID NO: 68591 - DNA, 15 bp, Artificial Sequence
  dgRNA
  Cd3e
tcacagcactctcgg

SEQ ID NO: 68592 - DNA, 15 bp, Artificial Sequence
  dgRNA
  Cd3e
ctcagttaaccaagg

SEQ ID NO: 68593 - DNA, 15 bp, Artificial Sequence
  dgRNA
  Cd3e
agttaaccaaggcgg

SEQ ID NO: 68594 - DNA, 15 bp, Artificial Sequence
  dgRNA
  Cd3e
catttccaagtgacg

SEQ ID NO: 68595 - DNA, 15 bp, Artificial Sequence
  dgRNA
  Rgl2
ggaaccgcgcgcgct

SEQ ID NO: 68596 - DNA, 15 bp, Artificial Sequence
  dgRNA
  Rgl2
gaaccgcgcgcgctc

SEQ ID NO: 68597 - DNA, 15 bp, Artificial Sequence
  dgRNA
  Rgl2
gcgcgctcgggcgca

SEQ ID NO: 68598 - DNA, 15 bp, Artificial Sequence
  dgRNA
  Rgl2
gcgcacggtgagagc

SEQ ID NO: 68599 - DNA, 15 bp, Artificial Sequence
  dgRNA
  Csmd1
gcacctcccactcgc

SEQ ID NO: 68600 - DNA, 15 bp, Artificial Sequence
  dgRNA
  Csmd1
cgctgccgtggtggc

SEQ ID NO: 68601 - DNA, 15 bp, Artificial Sequence
  dgRNA
  Csmd1
gagccgctgccgtgg

SEQ ID NO: 68602 - DNA, 15 bp, Artificial Sequence
  dgRNA
  Csmd1
aaggagccgctgccg

SEQ ID NO: 68603 - DNA, 15 bp, Artificial Sequence
  dgRNA
  Pcyt1b
caagttcaggcccgg

SEQ ID NO: 68604 - DNA, 15 bp, Artificial Sequence
  dgRNA
  Pcyt1b
aagttcaggcccggt

SEQ ID NO: 68605 - DNA, 15 bp, Artificial Sequence
  dgRNA
  Pcyt1b
cccggtgggtaaggc

SEQ ID NO: 68606 - DNA, 15 bp, Artificial Sequence
  dgRNA
  Pcyt1b
ccagccaatgggccc

SEQ ID NO: 68607 - DNA, 15 bp, Artificial Sequence
  dgRNA
  Hook3
cgcgcccgcgggcct

SEQ ID NO: 68608 - DNA, 15 bp, Artificial Sequence
  dgRNA
  Hook3
ccgcgggccttggac

SEQ ID NO: 68609 - DNA, 15 bp, Artificial Sequence
  dgRNA
  Hook3
tgggagcgcgcctct

SEQ ID NO: 68610 - DNA, 15 bp, Artificial Sequence
  dgRNA
  Hook3
ggagcgcgcctctag

SEQ ID NO: 68611 - DNA, 15 bp, Artificial Sequence
  dgRNA
  Cldn22
acaaacaaggccccg

SEQ ID NO: 68612 - DNA, 15 bp, Artificial Sequence
  dgRNA
  Cldn22
ggccactccttagca

SEQ ID NO: 68613 - DNA, 15 bp, Artificial Sequence
  dgRNA
  Cldn22
actccttagcatggc

SEQ ID NO: 68614 - DNA, 15 bp, Artificial Sequence
  dgRNA
  Cldn22
tgaaacctttcaata

SEQ ID NO: 68615 - DNA, 15 bp, Artificial Sequence
  dgRNA
  Tuba8
gcctcggagtggatg

SEQ ID NO: 68616 - DNA, 15 bp, Artificial Sequence
  dgRNA
  Tuba8
cctcggagtggatgc

SEQ ID NO: 68617 - DNA, 15 bp, Artificial Sequence
  dgRNA
  Tuba8
ctcggagtggatgcg

SEQ ID NO: 68618 - DNA, 15 bp, Artificial Sequence
  dgRNA
  Tuba8
gtgtgttgcggtcac

SEQ ID NO: 68619 - DNA, 15 bp, Artificial Sequence
  dgRNA
  Eef1a1
ccccaccacagtgcg

SEQ ID NO: 68620 - DNA, 15 bp, Artificial Sequence
  dgRNA
  Eef1a1
gaggagcatgcgctc

SEQ ID NO: 68621 - DNA, 15 bp, Artificial Sequence
  dgRNA
  Eef1a1
aggagcatgcgctca

SEQ ID NO: 68622 - DNA, 15 bp, Artificial Sequence
  dgRNA
  Eef1a1
tcagggctgagcgcg

SEQ ID NO: 68623 - DNA, 15 bp, Artificial Sequence
  dgRNA
  Sel1l3
gggggcgggaccacg

SEQ ID NO: 68624 - DNA, 15 bp, Artificial Sequence
  dgRNA
  Sel1l3
ggtccccacctgtgt

SEQ ID NO: 68625 - DNA, 15 bp, Artificial Sequence
  dgRNA
  Sel1l3
ctgtgtgggcgccta

SEQ ID NO: 68626 - DNA, 15 bp, Artificial Sequence
  dgRNA
  Sel1l3
tgggcgcctacggcc

SEQ ID NO: 68627 - DNA, 15 bp, Artificial Sequence
  dgRNA
  Trim60
caactccgtaagctc

SEQ ID NO: 68628 - DNA, 15 bp, Artificial Sequence
  dgRNA
  Trim60
tccgtaagctctgga

SEQ ID NO: 68629 - DNA, 15 bp, Artificial Sequence
  dgRNA
  Trim60
tactttcgtttagaa

SEQ ID NO: 68630 - DNA, 15 bp, Artificial Sequence
  dgRNA
  Trim60
tgggtttgatttcga

SEQ ID NO: 68631 - DNA, 15 bp, Artificial Sequence
  dgRNA
  Baat
tagttctgggtacac

SEQ ID NO: 68632 - DNA, 15 bp, Artificial Sequence
  dgRNA
  Baat
aggacgtggtttcag

SEQ ID NO: 68633 - DNA, 15 bp, Artificial Sequence
  dgRNA
  Baat
gaccagagtttgtta

SEQ ID NO: 68634 - DNA, 15 bp, Artificial Sequence
  dgRNA
  Baat
aaccacgtcctttgc

SEQ ID NO: 68635 - DNA, 15 bp, Artificial Sequence
  dgRNA
  Elovl4
cgaggtgtccccctg

SEQ ID NO: 68636 - DNA, 15 bp, Artificial Sequence
  dgRNA
  Elovl4
cctgcggcgttcctg

SEQ ID NO: 68637 - DNA, 15 bp, Artificial Sequence
  dgRNA
  Elovl4
cgcgcctgcgcaagc

SEQ ID NO: 68638 - DNA, 15 bp, Artificial Sequence
  dgRNA
  Elovl4
cagcatccccgcgcc

SEQ ID NO: 68639 - DNA, 15 bp, Artificial Sequence
  dgRNA
  Atmin
aacacgcgctcgccg

SEQ ID NO: 68640 - DNA, 15 bp, Artificial Sequence
  dgRNA
  Atmin
gctcgccgcggccgg

SEQ ID NO: 68641 - DNA, 15 bp, Artificial Sequence
  dgRNA
  Atmin
ctcgccgcggccggc

SEQ ID NO: 68642 - DNA, 15 bp, Artificial Sequence
  dgRNA
  Atmin
cggccaccgaccggc

SEQ ID NO: 68643 - DNA, 15 bp, Artificial Sequence
  dgRNA
  Tsc22d1
gagctgtgggccata

SEQ ID NO: 68644 - DNA, 15 bp, Artificial Sequence
  dgRNA
  Tsc22d1
gtcttgcggagcctt

SEQ ID NO: 68645 - DNA, 15 bp, Artificial Sequence
  dgRNA
  Tsc22d1
gctcaccctgtggtt

SEQ ID NO: 68646 - DNA, 15 bp, Artificial Sequence
  dgRNA
  Tsc22d1
tctcatcgctgtgac

SEQ ID NO: 68647 - DNA, 15 bp, Artificial Sequence
  dgRNA
  Arhgdib
gctcagacggctgat

SEQ ID NO: 68648 - DNA, 15 bp, Artificial Sequence
  dgRNA
  Arhgdib
ggctgatcggaagat

SEQ ID NO: 68649 - DNA, 15 bp, Artificial Sequence
  dgRNA
  Arhgdib
atatcgagacagccc

SEQ ID NO: 68650 - DNA, 15 bp, Artificial Sequence
  dgRNA
  Arhgdib
tatcgagacagccca

SEQ ID NO: 68651 - DNA, 15 bp, Artificial Sequence
  dgRNA
  Man2b2
gcgtgttatcctgga

SEQ ID NO: 68652 - DNA, 15 bp, Artificial Sequence
  dgRNA
  Man2b2
agcggtctccaagtc

SEQ ID NO: 68653 - DNA, 15 bp, Artificial Sequence
  dgRNA
  Man2b2
ggtctccaagtctgg

SEQ ID NO: 68654 - DNA, 15 bp, Artificial Sequence
  dgRNA
  Man2b2
gcaagaccaccatat

SEQ ID NO: 68655 - DNA, 15 bp, Artificial Sequence
  dgRNA
  Harbi1
ttcgtgtagaatgta

SEQ ID NO: 68656 - DNA, 15 bp, Artificial Sequence
  dgRNA
  Harbi1
acggaagcgaagcgc

SEQ ID NO: 68657 - DNA, 15 bp, Artificial Sequence
  dgRNA
  Harbi1
gcgaagcgcaggccg

SEQ ID NO: 68658 - DNA, 15 bp, Artificial Sequence
  dgRNA
  Harbi1
aagcgcaggccgcgg

SEQ ID NO: 68659 - DNA, 15 bp, Artificial Sequence
  dgRNA
  Tbc1d4
ccccgaggcgagatg

SEQ ID NO: 68660 - DNA, 15 bp, Artificial Sequence
  dgRNA
  Tbc1d4
cccgaggcgagatga

SEQ ID NO: 68661 - DNA, 15 bp, Artificial Sequence
  dgRNA
  Tbc1d4
ccgaggcgagatgag

SEQ ID NO: 68662 - DNA, 15 bp, Artificial Sequence
  dgRNA
  Tbc1d4
cgagatgaggggcgg

SEQ ID NO: 68663 - DNA, 15 bp, Artificial Sequence
  dgRNA
  Pcdha2
accctgtggctaaac

SEQ ID NO: 68664 - DNA, 15 bp, Artificial Sequence
  dgRNA
  L1cam
gggtcactctcatct

SEQ ID NO: 68665 - DNA, 15 bp, Artificial Sequence
  dgRNA
  L1cam
gtcactctcatctcg

SEQ ID NO: 68666 - DNA, 15 bp, Artificial Sequence
  dgRNA
  L1cam
ggtccctatcacgcg

SEQ ID NO: 68667 - DNA, 15 bp, Artificial Sequence
  dgRNA
  L1cam
gtccctatcacgcgc

SEQ ID NO: 68668 - DNA, 15 bp, Artificial Sequence
  dgRNA
  Dock11
ttaggccactcaggt

SEQ ID NO: 68669 - DNA, 15 bp, Artificial Sequence
  dgRNA
  Dock11
aggccactcaggtcg

SEQ ID NO: 68670 - DNA, 15 bp, Artificial Sequence
  dgRNA
  Dock11
tcaggtcggggccct

SEQ ID NO: 68671 - DNA, 15 bp, Artificial Sequence
  dgRNA
  Dock11
ggggcccttggtgag

SEQ ID NO: 68672 - DNA, 15 bp, Artificial Sequence
  dgRNA
  Plk5
ctcagtttcccggat

SEQ ID NO: 68673 - DNA, 15 bp, Artificial Sequence
  dgRNA
  Plk5
ttaacaagtcccaag

SEQ ID NO: 68674 - DNA, 15 bp, Artificial Sequence
  dgRNA
  Plk5
caagaggtgcaggtc

SEQ ID NO: 68675 - DNA, 15 bp, Artificial Sequence
  dgRNA
  Plk5
actaagccaggtatc

SEQ ID NO: 68676 - DNA, 15 bp, Artificial Sequence
  dgRNA
  Ttc14
ggaggttagcgcgtc

SEQ ID NO: 68677 - DNA, 15 bp, Artificial Sequence
  dgRNA
  Ttc14
gaggttagcgcgtcc

SEQ ID NO: 68678 - DNA, 15 bp, Artificial Sequence
  dgRNA
  Ttc14
gcttccctcggcttg

SEQ ID NO: 68679 - DNA, 15 bp, Artificial Sequence
  dgRNA
  Ttc14
cttccctcggcttgc

SEQ ID NO: 68680 - DNA, 15 bp, Artificial Sequence
  dgRNA
  Zfp593
ggaaaccggcaagtg

SEQ ID NO: 68681 - DNA, 15 bp, Artificial Sequence
  dgRNA
  Zfp593
ccggcaagtgaggat

SEQ ID NO: 68682 - DNA, 15 bp, Artificial Sequence
  dgRNA
  Zfp593
cggcaagtgaggatg

SEQ ID NO: 68683 - DNA, 15 bp, Artificial Sequence
  dgRNA
  Zfp593
gggcgggcagaatag

SEQ ID NO: 68684 - DNA, 15 bp, Artificial Sequence
  dgRNA
  Mcat
gtttaaggaaacgca

SEQ ID NO: 68685 - DNA, 15 bp, Artificial Sequence
  dgRNA
  Mcat
cgcacggaccactcc

SEQ ID NO: 68686 - DNA, 15 bp, Artificial Sequence
  dgRNA
  Mcat
atgagtaggtaacat

SEQ ID NO: 68687 - DNA, 15 bp, Artificial Sequence
  dgRNA
  Mcat
ggaacgtttttttac

SEQ ID NO: 68688 - DNA, 15 bp, Artificial Sequence
  dgRNA
  Rgs5
ccacaattttcgccc

SEQ ID NO: 68689 - DNA, 15 bp, Artificial Sequence
  dgRNA
  Rgs5
tggtcctcggagcca

SEQ ID NO: 68690 - DNA, 15 bp, Artificial Sequence
  dgRNA
  Rgs5
gctggggcatgtttc

SEQ ID NO: 68691 - DNA, 15 bp, Artificial Sequence
  dgRNA
  Rgs5
ccttcggtgggggct

SEQ ID NO: 68692 - DNA, 15 bp, Artificial Sequence
  dgRNA
  Ruvbl1
cagtcaaatgtggcc

SEQ ID NO: 68693 - DNA, 15 bp, Artificial Sequence
  dgRNA
  Ruvbl1
acagacggaagttac

SEQ ID NO: 68694 - DNA, 15 bp, Artificial Sequence
  dgRNA
  Ruvbl1
cagacggaagttact

SEQ ID NO: 68695 - DNA, 15 bp, Artificial Sequence
  dgRNA
  Ruvbl1
ggataagttccccca

SEQ ID NO: 68696 - DNA, 15 bp, Artificial Sequence
  dgRNA
  Spata31d1a
ggaccacgtggtgcc

SEQ ID NO: 68697 - DNA, 15 bp, Artificial Sequence
  dgRNA
  Spata31d1a
tgtgttgggaccacg

SEQ ID NO: 68698 - DNA, 15 bp, Artificial Sequence
  dgRNA
  Pxmp4
aatgagctctatgac

SEQ ID NO: 68699 - DNA, 15 bp, Artificial Sequence
  dgRNA
  Pxmp4
tatggacacaacggc

SEQ ID NO: 68700 - DNA, 15 bp, Artificial Sequence
  dgRNA
  Pxmp4
atggacacaacggca

SEQ ID NO: 68701 - DNA, 15 bp, Artificial Sequence
  dgRNA
  Pxmp4
acacaacggcagggc

SEQ ID NO: 68702 - DNA, 15 bp, Artificial Sequence
  dgRNA
  Pus7
cgtcctcgggagcgg

SEQ ID NO: 68703 - DNA, 15 bp, Artificial Sequence
  dgRNA
  Pus7
gtcctcgggagcgga

SEQ ID NO: 68704 - DNA, 15 bp, Artificial Sequence
  dgRNA
  Pus7
agcgggccccgcccc

SEQ ID NO: 68705 - DNA, 15 bp, Artificial Sequence
  dgRNA
  Pus7
gcgggccccgccccg

SEQ ID NO: 68706 - DNA, 15 bp, Artificial Sequence
  dgRNA
  Atad1
atgttatcggcccag

SEQ ID NO: 68707 - DNA, 15 bp, Artificial Sequence
  dgRNA
  Atad1
tgttatcggcccagc

SEQ ID NO: 68708 - DNA, 15 bp, Artificial Sequence
  dgRNA
  Atad1
gcccagcgggtacta

SEQ ID NO: 68709 - DNA, 15 bp, Artificial Sequence
  dgRNA
  Atad1
cgggtactaaggtgt

SEQ ID NO: 68710 - DNA, 15 bp, Artificial Sequence
  dgRNA
  Dhdds
cggctcacgtgacct

SEQ ID NO: 68711 - DNA, 15 bp, Artificial Sequence
  dgRNA
  Dhdds
cacgccccgcgagag

SEQ ID NO: 68712 - DNA, 15 bp, Artificial Sequence
  dgRNA
  Dhdds
cgcccccgagtacgc

SEQ ID NO: 68713 - DNA, 15 bp, Artificial Sequence
  dgRNA
  Dhdds
gcccccgagtacgca

SEQ ID NO: 68714 - DNA, 15 bp, Artificial Sequence
  dgRNA
  Npas3
cagagcagccgcgcc

SEQ ID NO: 68715 - DNA, 15 bp, Artificial Sequence
  dgRNA
  Npas3
gagcagccgcgcctg

SEQ ID NO: 68716 - DNA, 15 bp, Artificial Sequence
  dgRNA
  Npas3
tggggctccaagccg

SEQ ID NO: 68717 - DNA, 15 bp, Artificial Sequence
  dgRNA
  Npas3
tgatccgaatctttc

SEQ ID NO: 68718 - DNA, 15 bp, Artificial Sequence
  dgRNA
  Ltbp4
cagccttcgcgcctc

SEQ ID NO: 68719 - DNA, 15 bp, Artificial Sequence
  dgRNA
  Ltbp4
ccacgcgcccccgcg

SEQ ID NO: 68720 - DNA, 15 bp, Artificial Sequence
  dgRNA
  Ltbp4
cccgcgcggccgccc

SEQ ID NO: 68721 - DNA, 15 bp, Artificial Sequence
  dgRNA
  Ltbp4
gcgcggccgcccggg

SEQ ID NO: 68722 - DNA, 15 bp, Artificial Sequence
  dgRNA
  Atp5j2
tatgtcagtttatac

SEQ ID NO: 68723 - DNA, 15 bp, Artificial Sequence
  dgRNA
  Atp5j2
ttcaggcccaaattt

SEQ ID NO: 68724 - DNA, 15 bp, Artificial Sequence
  dgRNA
  Atp5j2
tgacaactcatgtat

SEQ ID NO: 68725 - DNA, 15 bp, Artificial Sequence
  dgRNA
  Atp5j2
gtgacaactcatgta

SEQ ID NO: 68726 - DNA, 15 bp, Artificial Sequence
  dgRNA
  Skint11
gcaatgttaagtgag

SEQ ID NO: 68727 - DNA, 15 bp, Artificial Sequence
  dgRNA
  Sirt2
tacgaaagcggttat

SEQ ID NO: 68728 - DNA, 15 bp, Artificial Sequence
  dgRNA
  Sirt2
acgaaagcggttatg

SEQ ID NO: 68729 - DNA, 15 bp, Artificial Sequence
  dgRNA
  Sirt2
gatcgcattgcctgc

SEQ ID NO: 68730 - DNA, 15 bp, Artificial Sequence
  dgRNA
  Sirt2
atcgcattgcctgcc

SEQ ID NO: 68731 - DNA, 15 bp, Artificial Sequence
  dgRNA
  Zfp964
cgagctgagcgaagt

SEQ ID NO: 68732 - DNA, 15 bp, Artificial Sequence
  dgRNA
  Zfp964
gagctgagcgaagtc

SEQ ID NO: 68733 - DNA, 15 bp, Artificial Sequence
  dgRNA
  Zfp964
gggccctagccaatc

SEQ ID NO: 68734 - DNA, 15 bp, Artificial Sequence
  dgRNA
  Zfp964
ggccctagccaatca

SEQ ID NO: 68735 - DNA, 15 bp, Artificial Sequence
  dgRNA
  Rai2
ccacgccctccccgt

SEQ ID NO: 68736 - DNA, 15 bp, Artificial Sequence
  dgRNA
  Rai2
tggtgtatatagtaa

SEQ ID NO: 68737 - DNA, 15 bp, Artificial Sequence
  dgRNA
  Rai2
gtgcggggtgacaga

SEQ ID NO: 68738 - DNA, 15 bp, Artificial Sequence
  dgRNA
  Rai2
gttgtgggcggtgcg

SEQ ID NO: 68739 - DNA, 15 bp, Artificial Sequence
  dgRNA
  Slc1a5
attgttattcaccct

SEQ ID NO: 68740 - DNA, 15 bp, Artificial Sequence
  dgRNA
  Slc1a5
ccctcgctcgccacc

SEQ ID NO: 68741 - DNA, 15 bp, Artificial Sequence
  dgRNA
  Slc1a5
accaatcagcgcttg

SEQ ID NO: 68742 - DNA, 15 bp, Artificial Sequence
  dgRNA
  Slc1a5
ccaatcagcgcttgc

SEQ ID NO: 68743 - DNA, 15 bp, Artificial Sequence
  dgRNA
  Tsc22d1
cccgggccccagccg

SEQ ID NO: 68744 - DNA, 15 bp, Artificial Sequence
  dgRNA
  Tsc22d1
agccgtcgcgagccc

SEQ ID NO: 68745 - DNA, 15 bp, Artificial Sequence
  dgRNA
  Tsc22d1
gccgtcgcgagccca

SEQ ID NO: 68746 - DNA, 15 bp, Artificial Sequence
  dgRNA
  Tsc22d1
ccgtcgcgagcccag

SEQ ID NO: 68747 - DNA, 15 bp, Artificial Sequence
  dgRNA
  Trhr
gattctgaatcagtc

SEQ ID NO: 68748 - DNA, 15 bp, Artificial Sequence
  dgRNA
  Trhr
agcagccgagcttgt

SEQ ID NO: 68749 - DNA, 15 bp, Artificial Sequence
  dgRNA
  Ccdc109b
aagcctcactacttc

SEQ ID NO: 68750 - DNA, 15 bp, Artificial Sequence
  dgRNA
  Ccdc109b
cactacttccggtcc

SEQ ID NO: 68751 - DNA, 15 bp, Artificial Sequence
  dgRNA
  Ccdc109b
ctcaagacgtatgtg

SEQ ID NO: 68752 - DNA, 15 bp, Artificial Sequence
  dgRNA
  Ccdc109b
tcaagacgtatgtga

SEQ ID NO: 68753 - DNA, 15 bp, Artificial Sequence
  dgRNA
  Foxp4
atcggcgcgcgggcg

SEQ ID NO: 68754 - DNA, 15 bp, Artificial Sequence
  dgRNA
  Foxp4
gatcggcgcgcgggc

SEQ ID NO: 68755 - DNA, 15 bp, Artificial Sequence
  dgRNA
  Foxp4
cgatcggcgcgcggg

SEQ ID NO: 68756 - DNA, 15 bp, Artificial Sequence
  dgRNA
  Foxp4
gagcgatcggcgcgc

SEQ ID NO: 68757 - DNA, 15 bp, Artificial Sequence
  dgRNA
  Git1
ggcggagggcgcccg

SEQ ID NO: 68758 - DNA, 15 bp, Artificial Sequence
  dgRNA
  Git1
gcggagggcgcccga

SEQ ID NO: 68759 - DNA, 15 bp, Artificial Sequence
  dgRNA
  Git1
gcgcccgagggcgag

SEQ ID NO: 68760 - DNA, 15 bp, Artificial Sequence
  dgRNA
  Git1
cgcccgagggcgagc

SEQ ID NO: 68761 - DNA, 15 bp, Artificial Sequence
  dgRNA
  Vmn2r27
ggagtgtttgaatac

SEQ ID NO: 68762 - DNA, 15 bp, Artificial Sequence
  dgRNA
  Vmn2r27
atgttgattagtcca

SEQ ID NO: 68763 - DNA, 15 bp, Artificial Sequence
  dgRNA
  Vmn2r27
ttcagttaagaacct

SEQ ID NO: 68764 - DNA, 15 bp, Artificial Sequence
  dgRNA
  Plxnd1
taacaaacaagcgag

SEQ ID NO: 68765 - DNA, 15 bp, Artificial Sequence
  dgRNA
  Plxnd1
caacttgcgactgcc

SEQ ID NO: 68766 - DNA, 15 bp, Artificial Sequence
  dgRNA
  Plxnd1
aacttgcgactgccc

SEQ ID NO: 68767 - DNA, 15 bp, Artificial Sequence
  dgRNA
  Plxnd1
cgactgcccgggtat

SEQ ID NO: 68768 - DNA, 15 bp, Artificial Sequence
  dgRNA
  Mia2
gggccagcgccccat

SEQ ID NO: 68769 - DNA, 15 bp, Artificial Sequence
  dgRNA
  Mia2
ggccagcgccccatc

SEQ ID NO: 68770 - DNA, 15 bp, Artificial Sequence
  dgRNA
  Mia2
aaaatgtagctacga

SEQ ID NO: 68771 - DNA, 15 bp, Artificial Sequence
  dgRNA
  Mia2
aaatgtagctacgaa

SEQ ID NO: 68772 - DNA, 15 bp, Artificial Sequence
  dgRNA
  Zdhhc13
agtgggaaccctaag

SEQ ID NO: 68773 - DNA, 15 bp, Artificial Sequence
  dgRNA
  Zdhhc13
ccctaagtggtgcca

SEQ ID NO: 68774 - DNA, 15 bp, Artificial Sequence
  dgRNA
  Zdhhc13
cctaagtggtgccaa

SEQ ID NO: 68775 - DNA, 15 bp, Artificial Sequence
  dgRNA
  Zdhhc13
aagtggtgccaaggg

SEQ ID NO: 68776 - DNA, 15 bp, Artificial Sequence
  dgRNA
  Tubgcp6
aggcctcgcccactt

SEQ ID NO: 68777 - DNA, 15 bp, Artificial Sequence
  dgRNA
  Tubgcp6
ggcctcgcccactta

SEQ ID NO: 68778 - DNA, 15 bp, Artificial Sequence
  dgRNA
  Tubgcp6
ctcgcccacttaggg

SEQ ID NO: 68779 - DNA, 15 bp, Artificial Sequence
  dgRNA
  Tubgcp6
tcgcccacttagggc

SEQ ID NO: 68780 - DNA, 15 bp, Artificial Sequence
  dgRNA
  Tbc1d22a
agcgtcgccttctca

SEQ ID NO: 68781 - DNA, 15 bp, Artificial Sequence
  dgRNA
  Tbc1d22a
cactgcccgaaacga

SEQ ID NO: 68782 - DNA, 15 bp, Artificial Sequence
  dgRNA
  Tbc1d22a
tgcccgaaacgaagg

SEQ ID NO: 68783 - DNA, 15 bp, Artificial Sequence
  dgRNA
  Tbc1d22a
gcccgaaacgaaggc

SEQ ID NO: 68784 - DNA, 15 bp, Artificial Sequence
  dgRNA
  Trim40
gtgagtgcagctcat

SEQ ID NO: 68785 - DNA, 15 bp, Artificial Sequence
  dgRNA
  Trim40
tttcttacggggaag

SEQ ID NO: 68786 - DNA, 15 bp, Artificial Sequence
  dgRNA
  Trim40
gcatattttcttacg

SEQ ID NO: 68787 - DNA, 15 bp, Artificial Sequence
  dgRNA
  Trim40
gatgaactttgtggc

SEQ ID NO: 68788 - DNA, 15 bp, Artificial Sequence
  dgRNA
  Actbl2
ttattagcacctcaa

SEQ ID NO: 68789 - DNA, 15 bp, Artificial Sequence
  dgRNA
  Actbl2
cccgcccagaaatgc

SEQ ID NO: 68790 - DNA, 15 bp, Artificial Sequence
  dgRNA
  Actbl2
ccgcccagaaatgct

SEQ ID NO: 68791 - DNA, 15 bp, Artificial Sequence
  dgRNA
  Actbl2
aaatacctgtgctcg

SEQ ID NO: 68792 - DNA, 15 bp, Artificial Sequence
  dgRNA
  Prdm14
aactgttaggttaag

SEQ ID NO: 68793 - DNA, 15 bp, Artificial Sequence
  dgRNA
  Prdm14
actgttaggttaagt

SEQ ID NO: 68794 - DNA, 15 bp, Artificial Sequence
  dgRNA
  Prdm14
taagtgggtgatctc

SEQ ID NO: 68795 - DNA, 15 bp, Artificial Sequence
  dgRNA
  Prdm14
gctcgccaatgagtg

SEQ ID NO: 68796 - DNA, 15 bp, Artificial Sequence
  dgRNA
  Casq2
cgctgacacgctgca

SEQ ID NO: 68797 - DNA, 15 bp, Artificial Sequence
  dgRNA
  Casq2
catgcagcgtgtcag

SEQ ID NO: 68798 - DNA, 15 bp, Artificial Sequence
  dgRNA
  Prkar1b
ggtaggaggtccggg

SEQ ID NO: 68799 - DNA, 15 bp, Artificial Sequence
  dgRNA
  Prkar1b
ggaggtccgggtggc

SEQ ID NO: 68800 - DNA, 15 bp, Artificial Sequence
  dgRNA
  Prkar1b
tgtgtgcggggacgc

SEQ ID NO: 68801 - DNA, 15 bp, Artificial Sequence
  dgRNA
  Prkar1b
gtgtgcggggacgcg

SEQ ID NO: 68802 - DNA, 15 bp, Artificial Sequence
  dgRNA
  Tigd4
aatgaatcgtcttaa

SEQ ID NO: 68803 - DNA, 15 bp, Artificial Sequence
  dgRNA
  Tigd4
caaaaataccccagc

SEQ ID NO: 68804 - DNA, 15 bp, Artificial Sequence
  dgRNA
  Tigd4
ataccccagcaggac

SEQ ID NO: 68805 - DNA, 15 bp, Artificial Sequence
  dgRNA
  Tigd4
cacaagatcctaaga

SEQ ID NO: 68806 - DNA, 15 bp, Artificial Sequence
  dgRNA
  Gpr55
gcggggcattctaag

SEQ ID NO: 68807 - DNA, 15 bp, Artificial Sequence
  dgRNA
  Gpr55
gttcatgtcaaggca

SEQ ID NO: 68808 - DNA, 15 bp, Artificial Sequence
  dgRNA
  Gpr55
agttcatgtcaaggc

SEQ ID NO: 68809 - DNA, 15 bp, Artificial Sequence
  dgRNA
  Gpr55
ggatagttcatgtca

SEQ ID NO: 68810 - DNA, 15 bp, Artificial Sequence
  dgRNA
  Igsf8
agttcgcccagcctg

SEQ ID NO: 68811 - DNA, 15 bp, Artificial Sequence
  dgRNA
  Igsf8
ggcggagccaccatc

SEQ ID NO: 68812 - DNA, 15 bp, Artificial Sequence
  dgRNA
  Igsf8
gcggagccaccatca

SEQ ID NO: 68813 - DNA, 15 bp, Artificial Sequence
  dgRNA
  Igsf8
atcagggtcgaagtc

SEQ ID NO: 68814 - DNA, 15 bp, Artificial Sequence
  dgRNA
  Wdhd1
cagctctcggcttcg

SEQ ID NO: 68815 - DNA, 15 bp, Artificial Sequence
  dgRNA
  Wdhd1
ctctcggcttcgagg

SEQ ID NO: 68816 - DNA, 15 bp, Artificial Sequence
  dgRNA
  Wdhd1
tctgacgccaccacc

SEQ ID NO: 68817 - DNA, 15 bp, Artificial Sequence
  dgRNA
  Wdhd1
accacccggcgacct

SEQ ID NO: 68818 - DNA, 15 bp, Artificial Sequence
  dgRNA
  Hbs1l
cctgaaaaccggtgt

SEQ ID NO: 68819 - DNA, 15 bp, Artificial Sequence
  dgRNA
  Hbs1l
aaccggtgtaggtga

SEQ ID NO: 68820 - DNA, 15 bp, Artificial Sequence
  dgRNA
  Hbs1l
cgctcaacaaccctc

SEQ ID NO: 68821 - DNA, 15 bp, Artificial Sequence
  dgRNA
  Hbs1l
cagtcaattcgcttg

SEQ ID NO: 68822 - DNA, 15 bp, Artificial Sequence
  dgRNA
  Alyref2
ggtatgcaaatatcg

SEQ ID NO: 68823 - DNA, 15 bp, Artificial Sequence
  dgRNA
  Alyref2
cgcggagaagccgcg

SEQ ID NO: 68824 - DNA, 15 bp, Artificial Sequence
  dgRNA
  Alyref2
gccgcgtggcccgct

SEQ ID NO: 68825 - DNA, 15 bp, Artificial Sequence
  dgRNA
  Alyref2
ggcccgctcggtttc

SEQ ID NO: 68826 - DNA, 15 bp, Artificial Sequence
  dgRNA
  Tbc1d1
gtgagcaggtccggg

SEQ ID NO: 68827 - DNA, 15 bp, Artificial Sequence
  dgRNA
  Tbc1d1
tgagcaggtccgggt

SEQ ID NO: 68828 - DNA, 15 bp, Artificial Sequence
  dgRNA
  Tbc1d1
caggtccgggtgggc

SEQ ID NO: 68829 - DNA, 15 bp, Artificial Sequence
  dgRNA
  Tbc1d1
aggtccgggtgggcg

SEQ ID NO: 68830 - DNA, 15 bp, Artificial Sequence
  dgRNA
  Lrrc10
atatgtgagttggac

SEQ ID NO: 68831 - DNA, 15 bp, Artificial Sequence
  dgRNA
  Lrrc10
actcaagctgctatc

SEQ ID NO: 68832 - DNA, 15 bp, Artificial Sequence
  dgRNA
  Lrrc10
tttgtcaccgaattc

SEQ ID NO: 68833 - DNA, 15 bp, Artificial Sequence
  dgRNA
  Lrrc10
ttgtcaccgaattcc

SEQ ID NO: 68834 - DNA, 15 bp, Artificial Sequence
  dgRNA
  Map1lc3b
caagggagcggacat

SEQ ID NO: 68835 - DNA, 15 bp, Artificial Sequence
  dgRNA
  Map1lc3b
cattggaccaccagc

SEQ ID NO: 68836 - DNA, 15 bp, Artificial Sequence
  dgRNA
  Map1lc3b
cagctggatcatgca

SEQ ID NO: 68837 - DNA, 15 bp, Artificial Sequence
  dgRNA
  Map1lc3b
agcgcccagcgtagc

SEQ ID NO: 68838 - DNA, 15 bp, Artificial Sequence
  dgRNA
  Map3k19
caatttggctaagat

SEQ ID NO: 68839 - DNA, 15 bp, Artificial Sequence
  dgRNA
  Map3k19
attattgatccaatt

SEQ ID NO: 68840 - DNA, 15 bp, Artificial Sequence
  dgRNA
  Map3k19
aaagcttaggatctc

SEQ ID NO: 68841 - DNA, 15 bp, Artificial Sequence
  dgRNA
  Wnt9a
gcgagccgagcagct

SEQ ID NO: 68842 - DNA, 15 bp, Artificial Sequence
  dgRNA
  Wnt9a
agccgagcagctcgg

SEQ ID NO: 68843 - DNA, 15 bp, Artificial Sequence
  dgRNA
  Wnt9a
gcagctcggcggccg

SEQ ID NO: 68844 - DNA, 15 bp, Artificial Sequence
  dgRNA
  Wnt9a
gcgcagctcggattt

SEQ ID NO: 68845 - DNA, 15 bp, Artificial Sequence
  dgRNA
  Tfpi
gcagtccctcttcaa

SEQ ID NO: 68846 - DNA, 15 bp, Artificial Sequence
  dgRNA
  Tfpi
atttccgcccctata

SEQ ID NO: 68847 - DNA, 15 bp, Artificial Sequence
  dgRNA
  Tfpi
tttccgcccctataa

SEQ ID NO: 68848 - DNA, 15 bp, Artificial Sequence
  dgRNA
  Tfpi
ttccgcccctataag

SEQ ID NO: 68849 - DNA, 15 bp, Artificial Sequence
  dgRNA
  Gsn
ctttcctcgggacag

SEQ ID NO: 68850 - DNA, 15 bp, Artificial Sequence
  dgRNA
  Gsn
gaagcggttgtgcac

SEQ ID NO: 68851 - DNA, 15 bp, Artificial Sequence
  dgRNA
  Gsn
gatgaatgcttagcc

SEQ ID NO: 68852 - DNA, 15 bp, Artificial Sequence
  dgRNA
  Gsn
ccccgcccgcctcga

SEQ ID NO: 68853 - DNA, 15 bp, Artificial Sequence
  dgRNA
  Akp3
gccactttgatccat

SEQ ID NO: 68854 - DNA, 15 bp, Artificial Sequence
  dgRNA
  Akp3
actttgatccatggg

SEQ ID NO: 68855 - DNA, 15 bp, Artificial Sequence
  dgRNA
  Akp3
tggtgttgtgcagtt

SEQ ID NO: 68856 - DNA, 15 bp, Artificial Sequence
  dgRNA
  Akp3
cccctatttaagtcc

SEQ ID NO: 68857 - DNA, 15 bp, Artificial Sequence
  dgRNA
  Tpk1
tgtaaacataccaat

SEQ ID NO: 68858 - DNA, 15 bp, Artificial Sequence
  dgRNA
  Pnisr
ttacctcctttcggg

SEQ ID NO: 68859 - DNA, 15 bp, Artificial Sequence
  dgRNA
  Pnisr
cttggagtttaggta

SEQ ID NO: 68860 - DNA, 15 bp, Artificial Sequence
  dgRNA
  Pnisr
agggggcgcgatgct

SEQ ID NO: 68861 - DNA, 15 bp, Artificial Sequence
  dgRNA
  Pnisr
ccgaaaggaggtaaa

SEQ ID NO: 68862 - DNA, 15 bp, Artificial Sequence
  dgRNA
  Peg12
tttgaattctgctag

SEQ ID NO: 68863 - DNA, 15 bp, Artificial Sequence
  dgRNA
  Peg12
atatatgagtccctc

SEQ ID NO: 68864 - DNA, 15 bp, Artificial Sequence
  dgRNA
  Peg12
tatgagtccctctgg

SEQ ID NO: 68865 - DNA, 15 bp, Artificial Sequence
  dgRNA
  Peg12
aggttccggctcccg

SEQ ID NO: 68866 - DNA, 15 bp, Artificial Sequence
  dgRNA
  Mon1a
ctaagacacggaaga

SEQ ID NO: 68867 - DNA, 15 bp, Artificial Sequence
  dgRNA
  Mon1a
ccaggtgaggcaacc

SEQ ID NO: 68868 - DNA, 15 bp, Artificial Sequence
  dgRNA
  Mon1a
gtcagaccccgcctc

SEQ ID NO: 68869 - DNA, 15 bp, Artificial Sequence
  dgRNA
  Mon1a
gcctctggcatcgcc

SEQ ID NO: 68870 - DNA, 15 bp, Artificial Sequence
  dgRNA
  Olfr70
tggacactgatcctt

SEQ ID NO: 68871 - DNA, 15 bp, Artificial Sequence
  dgRNA
  Olfr70
ggacactgatccttg

SEQ ID NO: 68872 - DNA, 15 bp, Artificial Sequence
  dgRNA
  Olfr70
tcctagttatgagct

SEQ ID NO: 68873 - DNA, 15 bp, Artificial Sequence
  dgRNA
  Olfr70
cgagctgagggactt

SEQ ID NO: 68874 - DNA, 15 bp, Artificial Sequence
  dgRNA
  Nlgn1
tttccaaaatccccg

SEQ ID NO: 68875 - DNA, 15 bp, Artificial Sequence
  dgRNA
  Nlgn1
aaatccccggggccc

SEQ ID NO: 68876 - DNA, 15 bp, Artificial Sequence
  dgRNA
  Nlgn1
ggagggatcgggtgc

SEQ ID NO: 68877 - DNA, 15 bp, Artificial Sequence
  dgRNA
  Nlgn1
gagggatcgggtgct

SEQ ID NO: 68878 - DNA, 15 bp, Artificial Sequence
  dgRNA
  Jazf1
cccgctgcctcccgg

SEQ ID NO: 68879 - DNA, 15 bp, Artificial Sequence
  dgRNA
  Jazf1
caacctccgcgaccc

SEQ ID NO: 68880 - DNA, 15 bp, Artificial Sequence
  dgRNA
  Jazf1
gactcggcggctggg

SEQ ID NO: 68881 - DNA, 15 bp, Artificial Sequence
  dgRNA
  Jazf1
gaggactcggcggct

SEQ ID NO: 68882 - DNA, 15 bp, Artificial Sequence
  dgRNA
  Mov10
cgctcgcttccgtac

SEQ ID NO: 68883 - DNA, 15 bp, Artificial Sequence
  dgRNA
  Mov10
cagtacggaagcgag

SEQ ID NO: 68884 - DNA, 15 bp, Artificial Sequence
  dgRNA
  Mov10
ggacataaaccagta

SEQ ID NO: 68885 - DNA, 15 bp, Artificial Sequence
  dgRNA
  Sfxn2
gcccgcccattgcgc

SEQ ID NO: 68886 - DNA, 15 bp, Artificial Sequence
  dgRNA
  Sfxn2
cgcccattgcgcagg

SEQ ID NO: 68887 - DNA, 15 bp, Artificial Sequence
  dgRNA
  Sfxn2
ttgcgcaggcggtct

SEQ ID NO: 68888 - DNA, 15 bp, Artificial Sequence
  dgRNA
  Sfxn2
tgcgcaggcggtctc

SEQ ID NO: 68889 - DNA, 15 bp, Artificial Sequence
  dgRNA
  Pctp
cctgccaatcaggtt

SEQ ID NO: 68890 - DNA, 15 bp, Artificial Sequence
  dgRNA
  Pctp
aagctgtcgcttatc

SEQ ID NO: 68891 - DNA, 15 bp, Artificial Sequence
  dgRNA
  Pctp
ggcggggctaagcaa

SEQ ID NO: 68892 - DNA, 15 bp, Artificial Sequence
  dgRNA
  Pctp
atctgaagacaggcg

SEQ ID NO: 68893 - DNA, 15 bp, Artificial Sequence
  dgRNA
  Adamts14
atcaggccgtgactc

SEQ ID NO: 68894 - DNA, 15 bp, Artificial Sequence
  dgRNA
  Adamts14
gactccggaaagctc

SEQ ID NO: 68895 - DNA, 15 bp, Artificial Sequence
  dgRNA
  Adamts14
gctctggcgtctgaa

SEQ ID NO: 68896 - DNA, 15 bp, Artificial Sequence
  dgRNA
  Adamts14
gatcaccccgtacgc

SEQ ID NO: 68897 - DNA, 15 bp, Artificial Sequence
  dgRNA
  Greb1l
acgtgggcgtgtatt

SEQ ID NO: 68898 - DNA, 15 bp, Artificial Sequence
  dgRNA
  Greb1l
cttctgtacactcta

SEQ ID NO: 68899 - DNA, 15 bp, Artificial Sequence
  dgRNA
  Greb1l
acactctaaggttga

SEQ ID NO: 68900 - DNA, 15 bp, Artificial Sequence
  dgRNA
  Greb1l
gcaagggagcccaaa

SEQ ID NO: 68901 - DNA, 15 bp, Artificial Sequence
  dgRNA
  Raly
ccaaagcccggcgcg

SEQ ID NO: 68902 - DNA, 15 bp, Artificial Sequence
  dgRNA
  Raly
caaagcccggcgcga

SEQ ID NO: 68903 - DNA, 15 bp, Artificial Sequence
  dgRNA
  Raly
aaagcccggcgcgag

SEQ ID NO: 68904 - DNA, 15 bp, Artificial Sequence
  dgRNA
  Raly
gcgcgaggggtgtgc

SEQ ID NO: 68905 - DNA, 15 bp, Artificial Sequence
  dgRNA
  Nsun4
aatttcgttctacct

SEQ ID NO: 68906 - DNA, 15 bp, Artificial Sequence
  dgRNA
  Nsun4
ttcgtgtgcgccccg

SEQ ID NO: 68907 - DNA, 15 bp, Artificial Sequence
  dgRNA
  Nsun4
gcgccccgaggattc

SEQ ID NO: 68908 - DNA, 15 bp, Artificial Sequence
  dgRNA
  Nsun4
cccgaggattctggt

SEQ ID NO: 68909 - DNA, 15 bp, Artificial Sequence
  dgRNA
  Nosip
gcaactgccccgctc

SEQ ID NO: 68910 - DNA, 15 bp, Artificial Sequence
  dgRNA
  Nosip
caactgccccgctct

SEQ ID NO: 68911 - DNA, 15 bp, Artificial Sequence
  dgRNA
  Nosip
accactttcgctcac

SEQ ID NO: 68912 - DNA, 15 bp, Artificial Sequence
  dgRNA
  Nosip
agtcactcacgtttc

SEQ ID NO: 68913 - DNA, 15 bp, Artificial Sequence
  dgRNA
  Rad50
ctgctcgtgttgctt

SEQ ID NO: 68914 - DNA, 15 bp, Artificial Sequence
  dgRNA
  Rad50
ccccgggcgtgcgag

SEQ ID NO: 68915 - DNA, 15 bp, Artificial Sequence
  dgRNA
  Rad50
ggcgtgcgagaggcg

SEQ ID NO: 68916 - DNA, 15 bp, Artificial Sequence
  dgRNA
  Rad50
cgggtctagctctgt

SEQ ID NO: 68917 - DNA, 15 bp, Artificial Sequence
  dgRNA
  Nrxn1
agccagagcacgggc

SEQ ID NO: 68918 - DNA, 15 bp, Artificial Sequence
  dgRNA
  Nrxn1
gccggccgctctcca

SEQ ID NO: 68919 - DNA, 15 bp, Artificial Sequence
  dgRNA
  Nrxn1
gcccgtgctctggct

SEQ ID NO: 68920 - DNA, 15 bp, Artificial Sequence
  dgRNA
  Nrxn1
ggccggcccgtgctc

SEQ ID NO: 68921 - DNA, 15 bp, Artificial Sequence
  dgRNA
  Galnt1
gaggtctacttcacc

SEQ ID NO: 68922 - DNA, 15 bp, Artificial Sequence
  dgRNA
  Galnt1
gtccccgaggtccgg

SEQ ID NO: 68923 - DNA, 15 bp, Artificial Sequence
  dgRNA
  Galnt1
cctcttccggctgtg

SEQ ID NO: 68924 - DNA, 15 bp, Artificial Sequence
  dgRNA
  Galnt1
ctcttccggctgtgt

SEQ ID NO: 68925 - DNA, 15 bp, Artificial Sequence
  dgRNA
  Mrpl40
ctcgcgagcgccagc

SEQ ID NO: 68926 - DNA, 15 bp, Artificial Sequence
  dgRNA
  Mrpl40
tcgcgagcgccagcc

SEQ ID NO: 68927 - DNA, 15 bp, Artificial Sequence
  dgRNA
  Mrpl40
cgagcgccagccggg

SEQ ID NO: 68928 - DNA, 15 bp, Artificial Sequence
  dgRNA
  Mrpl40
gagcgccagccgggc

SEQ ID NO: 68929 - DNA, 15 bp, Artificial Sequence
  dgRNA
  Rnf123
gcatatgcgcgtgcg

SEQ ID NO: 68930 - DNA, 15 bp, Artificial Sequence
  dgRNA
  Rnf123
atgcgcgtgcgcggc

SEQ ID NO: 68931 - DNA, 15 bp, Artificial Sequence
  dgRNA
  Rnf123
ggagcagcgctcgag

SEQ ID NO: 68932 - DNA, 15 bp, Artificial Sequence
  dgRNA
  Rnf123
gagcagcgctcgagc

SEQ ID NO: 68933 - DNA, 15 bp, Artificial Sequence
  dgRNA
  Olfr619
gagcattttatgaac

SEQ ID NO: 68934 - DNA, 15 bp, Artificial Sequence
  dgRNA
  Col15a1
tgtggcacagcaacc

SEQ ID NO: 68935 - DNA, 15 bp, Artificial Sequence
  dgRNA
  Col15a1
tcaaccgcgtagctt

SEQ ID NO: 68936 - DNA, 15 bp, Artificial Sequence
  dgRNA
  Col15a1
caaccgcgtagcttt

SEQ ID NO: 68937 - DNA, 15 bp, Artificial Sequence
  dgRNA
  Col15a1
cccagcgatcccagc

SEQ ID NO: 68938 - DNA, 15 bp, Artificial Sequence
  dgRNA
  Gja5
cgactggtgaggaaa

SEQ ID NO: 68939 - DNA, 15 bp, Artificial Sequence
  dgRNA
  Gja5
tctacgcacaaagag

SEQ ID NO: 68940 - DNA, 15 bp, Artificial Sequence
  dgRNA
  Gja5
ctacgcacaaagaga

SEQ ID NO: 68941 - DNA, 15 bp, Artificial Sequence
  dgRNA
  Gja5
tacgcacaaagagag

SEQ ID NO: 68942 - DNA, 15 bp, Artificial Sequence
  dgRNA
  Ghr
ttatatatagcaccg

SEQ ID NO: 68943 - DNA, 15 bp, Artificial Sequence
  dgRNA
  Ghr
ggggagtacgtctgc

SEQ ID NO: 68944 - DNA, 15 bp, Artificial Sequence
  dgRNA
  Ghr
gggagtacgtctgct

SEQ ID NO: 68945 - DNA, 15 bp, Artificial Sequence
  dgRNA
  Ghr
acgtctgctgggacc

SEQ ID NO: 68946 - DNA, 15 bp, Artificial Sequence
  dgRNA
  Cmc1
agtgcacacacgagg

SEQ ID NO: 68947 - DNA, 15 bp, Artificial Sequence
  dgRNA
  Cmc1
cacgaggcggcctct

SEQ ID NO: 68948 - DNA, 15 bp, Artificial Sequence
  dgRNA
  Cmc1
acgaggcggcctctt

SEQ ID NO: 68949 - DNA, 15 bp, Artificial Sequence
  dgRNA
  Cmc1
ttgggagagcatgcg

SEQ ID NO: 68950 - DNA, 15 bp, Artificial Sequence
  dgRNA
  Olfr570
atatagtcaaattag

SEQ ID NO: 68951 - DNA, 15 bp, Artificial Sequence
  dgRNA
  Slmo1
catcacttttgcgtg

SEQ ID NO: 68952 - DNA, 15 bp, Artificial Sequence
  dgRNA
  Slmo1
acttttgcgtgtggt

SEQ ID NO: 68953 - DNA, 15 bp, Artificial Sequence
  dgRNA
  Slmo1
tgcgtgtggttggac

SEQ ID NO: 68954 - DNA, 15 bp, Artificial Sequence
  dgRNA
  Slmo1
tcgcgctcgtccctg

SEQ ID NO: 68955 - DNA, 15 bp, Artificial Sequence
  dgRNA
  Pdlim3
aacccgaagcctcct

SEQ ID NO: 68956 - DNA, 15 bp, Artificial Sequence
  dgRNA
  Pdlim3
acccgaagcctcctt

SEQ ID NO: 68957 - DNA, 15 bp, Artificial Sequence
  dgRNA
  Pdlim3
cgaagcctccttggg

SEQ ID NO: 68958 - DNA, 15 bp, Artificial Sequence
  dgRNA
  Pdlim3
aagcctccttgggcg

SEQ ID NO: 68959 - DNA, 15 bp, Artificial Sequence
  dgRNA
  Ddx52
ctcagttacagtaac

SEQ ID NO: 68960 - DNA, 15 bp, Artificial Sequence
  dgRNA
  Ddx52
aagaagcgtcgattt

SEQ ID NO: 68961 - DNA, 15 bp, Artificial Sequence
  dgRNA
  Ddx52
atggaaagcatcgtg

SEQ ID NO: 68962 - DNA, 15 bp, Artificial Sequence
  dgRNA
  Ddx52
ggttaccgtttagaa

SEQ ID NO: 68963 - DNA, 15 bp, Artificial Sequence
  dgRNA
  Ppm1g
cacaatagagacttc

SEQ ID NO: 68964 - DNA, 15 bp, Artificial Sequence
  dgRNA
  Ppm1g
ccccgtgctaaagca

SEQ ID NO: 68965 - DNA, 15 bp, Artificial Sequence
  dgRNA
  Ppm1g
aaagcacggtcagcg

SEQ ID NO: 68966 - DNA, 15 bp, Artificial Sequence
  dgRNA
  Ppm1g
cggtcagcgtggaga

SEQ ID NO: 68967 - DNA, 15 bp, Artificial Sequence
  dgRNA
  Dlx6
ggatcccgggagcta

SEQ ID NO: 68968 - DNA, 15 bp, Artificial Sequence
  dgRNA
  Dlx6
taaggtggctgcaaa

SEQ ID NO: 68969 - DNA, 15 bp, Artificial Sequence
  dgRNA
  Dlx6
gcggtgcgagccaag

SEQ ID NO: 68970 - DNA, 15 bp, Artificial Sequence
  dgRNA
  Dlx6
cggtgcgagccaagt

SEQ ID NO: 68971 - DNA, 15 bp, Artificial Sequence
  dgRNA
  Gjb4
aaagccccaccctgc

SEQ ID NO: 68972 - DNA, 15 bp, Artificial Sequence
  dgRNA
  Gjb4
ccctgctggtaagtg

SEQ ID NO: 68973 - DNA, 15 bp, Artificial Sequence
  dgRNA
  Gjb4
acttaccagcagggt

SEQ ID NO: 68974 - DNA, 15 bp, Artificial Sequence
  dgRNA
  Gjb4
cacttaccagcaggg

SEQ ID NO: 68975 - DNA, 15 bp, Artificial Sequence
  dgRNA
  Adpgk
agctccacccataac

SEQ ID NO: 68976 - DNA, 15 bp, Artificial Sequence
  dgRNA
  Adpgk
gctccacccataact

SEQ ID NO: 68977 - DNA, 15 bp, Artificial Sequence
  dgRNA
  Adpgk
cgtagctccgcccat

SEQ ID NO: 68978 - DNA, 15 bp, Artificial Sequence
  dgRNA
  Adpgk
gtagctccgcccatc

SEQ ID NO: 68979 - DNA, 15 bp, Artificial Sequence
  dgRNA
  Pgrmc1
cccccgaggctacat

SEQ ID NO: 68980 - DNA, 15 bp, Artificial Sequence
  dgRNA
  Pgrmc1
ccccgaggctacata

SEQ ID NO: 68981 - DNA, 15 bp, Artificial Sequence
  dgRNA
  Pgrmc1
cccgaggctacatag

SEQ ID NO: 68982 - DNA, 15 bp, Artificial Sequence
  dgRNA
  Pgrmc1
ccgaggctacatagg

SEQ ID NO: 68983 - DNA, 15 bp, Artificial Sequence
  dgRNA
  Olfr936
tggtacagtaaaacg

SEQ ID NO: 68984 - DNA, 15 bp, Artificial Sequence
  dgRNA
  Olfr936
gtcatattgaattgt

SEQ ID NO: 68985 - DNA, 15 bp, Artificial Sequence
  dgRNA
  Olfr936
atattgaattgtagg

SEQ ID NO: 68986 - DNA, 15 bp, Artificial Sequence
  dgRNA
  Olfr458
ctaggttaaagtacc

SEQ ID NO: 68987 - DNA, 15 bp, Artificial Sequence
  dgRNA
  Il17rd
tgtgtcaatctccgg

SEQ ID NO: 68988 - DNA, 15 bp, Artificial Sequence
  dgRNA
  Il17rd
ctgtgcattggggcg

SEQ ID NO: 68989 - DNA, 15 bp, Artificial Sequence
  dgRNA
  Il17rd
cggggccaagaccga

SEQ ID NO: 68990 - DNA, 15 bp, Artificial Sequence
  dgRNA
  Il17rd
ggggccaagaccgaa

SEQ ID NO: 68991 - DNA, 15 bp, Artificial Sequence
  dgRNA
  Vsig10
ctcgctcttctcgtg

SEQ ID NO: 68992 - DNA, 15 bp, Artificial Sequence
  dgRNA
  Vsig10
agaacccgagtctcg

SEQ ID NO: 68993 - DNA, 15 bp, Artificial Sequence
  dgRNA
  Vsig10
ttggccggacggtcg

SEQ ID NO: 68994 - DNA, 15 bp, Artificial Sequence
  dgRNA
  Vsig10
tggccggacggtcgc

SEQ ID NO: 68995 - DNA, 15 bp, Artificial Sequence
  dgRNA
  Ifi27l2a
aacctctcaaagggg

SEQ ID NO: 68996 - DNA, 15 bp, Artificial Sequence
  dgRNA
  Ifi27l2a
gtccgcccctttgag

SEQ ID NO: 68997 - DNA, 15 bp, Artificial Sequence
  dgRNA
  Ifi27l2a
gaaccaatagggaca

SEQ ID NO: 68998 - DNA, 15 bp, Artificial Sequence
  dgRNA
  Ifi27l2a
ggaaccaatagggac

SEQ ID NO: 68999 - DNA, 15 bp, Artificial Sequence
  dgRNA
  Vps37c
ttccacgcttgtctc

SEQ ID NO: 69000 - DNA, 15 bp, Artificial Sequence
  dgRNA
  Vps37c
attcagagcaaacga

SEQ ID NO: 69001 - DNA, 15 bp, Artificial Sequence
  dgRNA
  Vps37c
ttcagagcaaacgaa

SEQ ID NO: 69002 - DNA, 15 bp, Artificial Sequence
  dgRNA
  Vps37c
cctgcaagtctgcgc

SEQ ID NO: 69003 - DNA, 15 bp, Artificial Sequence
  dgRNA
  Olfr353
aaactactgtcatgt

SEQ ID NO: 69004 - DNA, 15 bp, Artificial Sequence
  dgRNA
  Olfr353
gtctagagcatctgt

SEQ ID NO: 69005 - DNA, 15 bp, Artificial Sequence
  dgRNA
  Defb40
tcctgtttagacaag

SEQ ID NO: 69006 - DNA, 15 bp, Artificial Sequence
  dgRNA
  Defb40
gcacttagcattttc

SEQ ID NO: 69007 - DNA, 15 bp, Artificial Sequence
  dgRNA
  Defb40
tagagcttagctatt

SEQ ID NO: 69008 - DNA, 15 bp, Artificial Sequence
  dgRNA
  Defb40
tacagcgcttatcca

SEQ ID NO: 69009 - DNA, 15 bp, Artificial Sequence
  dgRNA
  Atl3
gtttcctctacgccc

SEQ ID NO: 69010 - DNA, 15 bp, Artificial Sequence
  dgRNA
  Atl3
tctacgccccggatg

SEQ ID NO: 69011 - DNA, 15 bp, Artificial Sequence
  dgRNA
  Atl3
ctacgccccggatga

SEQ ID NO: 69012 - DNA, 15 bp, Artificial Sequence
  dgRNA
  Atl3
atgagggcgaacacc

SEQ ID NO: 69013 - DNA, 15 bp, Artificial Sequence
  dgRNA
  Chrnb4
atcatccatagccac

SEQ ID NO: 69014 - DNA, 15 bp, Artificial Sequence
  dgRNA
  Chrnb4
gttcagtcctctaag

SEQ ID NO: 69015 - DNA, 15 bp, Artificial Sequence
  dgRNA
  Chrnb4
agtcctctaagtggg

SEQ ID NO: 69016 - DNA, 15 bp, Artificial Sequence
  dgRNA
  Chrnb4
gggtcctagtgccgc

SEQ ID NO: 69017 - DNA, 15 bp, Artificial Sequence
  dgRNA
  Lbp
agtggcttatcccct

SEQ ID NO: 69018 - DNA, 15 bp, Artificial Sequence
  dgRNA
  Lbp
tatccccttggcacc

SEQ ID NO: 69019 - DNA, 15 bp, Artificial Sequence
  dgRNA
  Lbp
gactctctgctagga

SEQ ID NO: 69020 - DNA, 15 bp, Artificial Sequence
  dgRNA
  Lbp
actgcacaggttagg

SEQ ID NO: 69021 - DNA, 15 bp, Artificial Sequence
  dgRNA
  Slc43a1
cgagagtggaaattt

SEQ ID NO: 69022 - DNA, 15 bp, Artificial Sequence
  dgRNA
  Slc43a1
gaaatttaggcgccc

SEQ ID NO: 69023 - DNA, 15 bp, Artificial Sequence
  dgRNA
  Slc43a1
aaatttaggcgcccc

SEQ ID NO: 69024 - DNA, 15 bp, Artificial Sequence
  dgRNA
  Slc43a1
gcgccccgggcgcac

SEQ ID NO: 69025 - DNA, 15 bp, Artificial Sequence
  dgRNA
  Olfr1443
gcaatgaagacctac

SEQ ID NO: 69026 - DNA, 15 bp, Artificial Sequence
  dgRNA
  Olfr1443
ctacaggtgccccat

SEQ ID NO: 69027 - DNA, 15 bp, Artificial Sequence
  dgRNA
  Olfr1443
tacaggtgccccatg

SEQ ID NO: 69028 - DNA, 15 bp, Artificial Sequence
  dgRNA
  Olfr1443
tccatccatagtgcc

SEQ ID NO: 69029 - DNA, 15 bp, Artificial Sequence
  dgRNA
  Slc39a9
agaagagttcgtttc

SEQ ID NO: 69030 - DNA, 15 bp, Artificial Sequence
  dgRNA
  Slc39a9
ctctaattaactgac

SEQ ID NO: 69031 - DNA, 15 bp, Artificial Sequence
  dgRNA
  Slc39a9
taattaactgacagg

SEQ ID NO: 69032 - DNA, 15 bp, Artificial Sequence
  dgRNA
  Slc39a9
aggcggctaaagtga

SEQ ID NO: 69033 - DNA, 15 bp, Artificial Sequence
  dgRNA
  Rgsl1
ggactgagtatagga

SEQ ID NO: 69034 - DNA, 15 bp, Artificial Sequence
  dgRNA
  Rgsl1
gactgagtataggat

SEQ ID NO: 69035 - DNA, 15 bp, Artificial Sequence
  dgRNA
  Rgsl1
agtataggatgggtc

SEQ ID NO: 69036 - DNA, 15 bp, Artificial Sequence
  dgRNA
  Rgsl1
catttaggtctgcac

SEQ ID NO: 69037 - DNA, 15 bp, Artificial Sequence
  dgRNA
  Cyp11b2
acccaatctcctatg

SEQ ID NO: 69038 - DNA, 15 bp, Artificial Sequence
  dgRNA
  Cyp11b2
tttctaaccactagc

SEQ ID NO: 69039 - DNA, 15 bp, Artificial Sequence
  dgRNA
  Cyp11b2
tctcgtccccctaga

SEQ ID NO: 69040 - DNA, 15 bp, Artificial Sequence
  dgRNA
  Cyp11b2
ggttgcctgaggtag

SEQ ID NO: 69041 - DNA, 15 bp, Artificial Sequence
  dgRNA
  Rnf38
gcctcagtcggaacc

SEQ ID NO: 69042 - DNA, 15 bp, Artificial Sequence
  dgRNA
  Rnf38
cctcagtcggaaccc

SEQ ID NO: 69043 - DNA, 15 bp, Artificial Sequence
  dgRNA
  Rnf38
ggaacccgggttccg

SEQ ID NO: 69044 - DNA, 15 bp, Artificial Sequence
  dgRNA
  Rnf38
gaacccgggttccga

SEQ ID NO: 69045 - DNA, 15 bp, Artificial Sequence
  dgRNA
  Frk
ctactcatatttgtg

SEQ ID NO: 69046 - DNA, 15 bp, Artificial Sequence
  dgRNA
  Frk
gctgctttaagaatc

SEQ ID NO: 69047 - DNA, 15 bp, Artificial Sequence
  dgRNA
  Frk
tcttggtaagggggc

SEQ ID NO: 69048 - DNA, 15 bp, Artificial Sequence
  dgRNA
  Frk
ggggctggtctatcc

SEQ ID NO: 69049 - DNA, 15 bp, Artificial Sequence
  dgRNA
  Slc29a1
cagtactgagggatt

SEQ ID NO: 69050 - DNA, 15 bp, Artificial Sequence
  dgRNA
  Slc29a1
gggatttggcccgtc

SEQ ID NO: 69051 - DNA, 15 bp, Artificial Sequence
  dgRNA
  Slc29a1
ggatttggcccgtct

SEQ ID NO: 69052 - DNA, 15 bp, Artificial Sequence
  dgRNA
  Slc29a1
tagaaaagcggctat

SEQ ID NO: 69053 - DNA, 15 bp, Artificial Sequence
  dgRNA
  Aldoa
aactattgtatgtga

SEQ ID NO: 69054 - DNA, 15 bp, Artificial Sequence
  dgRNA
  Aldoa
ggacattgctcaccc

SEQ ID NO: 69055 - DNA, 15 bp, Artificial Sequence
  dgRNA
  Aldoa
ggactatcaggataa

SEQ ID NO: 69056 - DNA, 15 bp, Artificial Sequence
  dgRNA
  Aldoa
tacaatagtttatca

SEQ ID NO: 69057 - DNA, 15 bp, Artificial Sequence
  dgRNA
  Med7
cggaagcacaagttc

SEQ ID NO: 69058 - DNA, 15 bp, Artificial Sequence
  dgRNA
  Fbxw4
cgcctcctctcgagg

SEQ ID NO: 69059 - DNA, 15 bp, Artificial Sequence
  dgRNA
  Fbxw4
ctcctctcgaggagg

SEQ ID NO: 69060 - DNA, 15 bp, Artificial Sequence
  dgRNA
  Fbxw4
ctctcgaggaggcgg

SEQ ID NO: 69061 - DNA, 15 bp, Artificial Sequence
  dgRNA
  Fbxw4
aggcggtggcgtctt

SEQ ID NO: 69062 - DNA, 15 bp, Artificial Sequence
  dgRNA
  Rps8
gtaagcacaacaggc

SEQ ID NO: 69063 - DNA, 15 bp, Artificial Sequence
  dgRNA
  Rps8
ttaagctgagctata

SEQ ID NO: 69064 - DNA, 15 bp, Artificial Sequence
  dgRNA
  Rps8
cttaagctgagctat

SEQ ID NO: 69065 - DNA, 15 bp, Artificial Sequence
  dgRNA
  Rps8
ggcggtctggagggc

SEQ ID NO: 69066 - DNA, 15 bp, Artificial Sequence
  dgRNA
  Pip5k1a
gatacgaacctatat

SEQ ID NO: 69067 - DNA, 15 bp, Artificial Sequence
  dgRNA
  Pip5k1a
gccaccgtagactca

SEQ ID NO: 69068 - DNA, 15 bp, Artificial Sequence
  dgRNA
  Pip5k1a
tagactcacggtcta

SEQ ID NO: 69069 - DNA, 15 bp, Artificial Sequence
  dgRNA
  Pip5k1a
ctcacggtctacggt

SEQ ID NO: 69070 - DNA, 15 bp, Artificial Sequence
  dgRNA
  Pclo
cgaaaactcaggttg

SEQ ID NO: 69071 - DNA, 15 bp, Artificial Sequence
  dgRNA
  Pclo
ctgctatatgcctga

SEQ ID NO: 69072 - DNA, 15 bp, Artificial Sequence
  dgRNA
  Pclo
gtgtccgcagttcgc

SEQ ID NO: 69073 - DNA, 15 bp, Artificial Sequence
  dgRNA
  Pclo
tgtccgcagttcgcc

SEQ ID NO: 69074 - DNA, 15 bp, Artificial Sequence
  dgRNA
  Dennd5b
tacgatcctgctctg

SEQ ID NO: 69075 - DNA, 15 bp, Artificial Sequence
  dgRNA
  Dennd5b
tgctcaaccgactgt

SEQ ID NO: 69076 - DNA, 15 bp, Artificial Sequence
  dgRNA
  Dennd5b
gctcaaccgactgtt

SEQ ID NO: 69077 - DNA, 15 bp, Artificial Sequence
  dgRNA
  Dennd5b
ctcaaccgactgttg

SEQ ID NO: 69078 - DNA, 15 bp, Artificial Sequence
  dgRNA
  Gnas
acctgccggcccact

SEQ ID NO: 69079 - DNA, 15 bp, Artificial Sequence
  dgRNA
  Gnas
cctgccggcccacta

SEQ ID NO: 69080 - DNA, 15 bp, Artificial Sequence
  dgRNA
  Gnas
ccaacgcacagctcg

SEQ ID NO: 69081 - DNA, 15 bp, Artificial Sequence
  dgRNA
  Gnas
caacgcacagctcgc

SEQ ID NO: 69082 - DNA, 15 bp, Artificial Sequence
  dgRNA
  Nid2
accagaccgggccaa

SEQ ID NO: 69083 - DNA, 15 bp, Artificial Sequence
  dgRNA
  Nid2
gagaaccacatgtag

SEQ ID NO: 69084 - DNA, 15 bp, Artificial Sequence
  dgRNA
  Nid2
acatgtagtggccgc

SEQ ID NO: 69085 - DNA, 15 bp, Artificial Sequence
  dgRNA
  Nid2
ctcagagtcgctgat

SEQ ID NO: 69086 - DNA, 15 bp, Artificial Sequence
  dgRNA
  F830016B08Rik
ttgtacacattcttc

SEQ ID NO: 69087 - DNA, 15 bp, Artificial Sequence
  dgRNA
  Fgfr3
gaaggggagtgttcg

SEQ ID NO: 69088 - DNA, 15 bp, Artificial Sequence
  dgRNA
  Fgfr3
gtgttcggggcgtgg

SEQ ID NO: 69089 - DNA, 15 bp, Artificial Sequence
  dgRNA
  Fgfr3
tgttcggggcgtggc

SEQ ID NO: 69090 - DNA, 15 bp, Artificial Sequence
  dgRNA
  Fgfr3
cgggctgctgcgcgc

SEQ ID NO: 69091 - DNA, 15 bp, Artificial Sequence
  dgRNA
  Olfr1116
tttgagttaggcgaa

SEQ ID NO: 69092 - DNA, 15 bp, Artificial Sequence
  dgRNA
  Olfr1116
ttgagttaggcgaat

SEQ ID NO: 69093 - DNA, 15 bp, Artificial Sequence
  dgRNA
  Bpifb6
ccttaattatccaag

SEQ ID NO: 69094 - DNA, 15 bp, Artificial Sequence
  dgRNA
  Bpifb6
tccaagcggctaatc

SEQ ID NO: 69095 - DNA, 15 bp, Artificial Sequence
  dgRNA
  Bpifb6
aggctcctgaatata

SEQ ID NO: 69096 - DNA, 15 bp, Artificial Sequence
  dgRNA
  Bpifb6
ggctcctgaatataa

SEQ ID NO: 69097 - DNA, 15 bp, Artificial Sequence
  dgRNA
  Kansl1
tgactgaggcggcgg

SEQ ID NO: 69098 - DNA, 15 bp, Artificial Sequence
  dgRNA
  Kansl1
ggcggccgcgcctcc

SEQ ID NO: 69099 - DNA, 15 bp, Artificial Sequence
  dgRNA
  Kansl1
ctcctggcagcccgc

SEQ ID NO: 69100 - DNA, 15 bp, Artificial Sequence
  dgRNA
  Kansl1
tcctggcagcccgcg

SEQ ID NO: 69101 - DNA, 15 bp, Artificial Sequence
  dgRNA
  Sertad2
ctcgccgctccttcc

SEQ ID NO: 69102 - DNA, 15 bp, Artificial Sequence
  dgRNA
  Sertad2
ccttcccggtccagc

SEQ ID NO: 69103 - DNA, 15 bp, Artificial Sequence
  dgRNA
  Sertad2
cttcccggtccagct

SEQ ID NO: 69104 - DNA, 15 bp, Artificial Sequence
  dgRNA
  Sertad2
cccggtccagctggg

SEQ ID NO: 69105 - DNA, 15 bp, Artificial Sequence
  dgRNA
  Pcdhb22
ttacaggttacacaa

SEQ ID NO: 69106 - DNA, 15 bp, Artificial Sequence
  dgRNA
  Pcdhb22
agtactacccattgc

SEQ ID NO: 69107 - DNA, 15 bp, Artificial Sequence
  dgRNA
  Pcdhb22
acaactattcaacta

SEQ ID NO: 69108 - DNA, 15 bp, Artificial Sequence
  dgRNA
  Aqp3
cccttaaagctccac

SEQ ID NO: 69109 - DNA, 15 bp, Artificial Sequence
  dgRNA
  Aqp3
cgcctccaggctagg

SEQ ID NO: 69110 - DNA, 15 bp, Artificial Sequence
  dgRNA
  Aqp3
cgcactccgcccccg

SEQ ID NO: 69111 - DNA, 15 bp, Artificial Sequence
  dgRNA
  Aqp3
gcactccgcccccgc

SEQ ID NO: 69112 - DNA, 15 bp, Artificial Sequence
  dgRNA
  Rhog
gtctcagggctcacg

SEQ ID NO: 69113 - DNA, 15 bp, Artificial Sequence
  dgRNA
  Rhog
tcacggggcgaagag

SEQ ID NO: 69114 - DNA, 15 bp, Artificial Sequence
  dgRNA
  Rhog
tgcgggactgtgcgg

SEQ ID NO: 69115 - DNA, 15 bp, Artificial Sequence
  dgRNA
  Rhog
gcgggactgtgcgga

SEQ ID NO: 69116 - DNA, 15 bp, Artificial Sequence
  dgRNA
  Cytip
gcggtaagaataaag

SEQ ID NO: 69117 - DNA, 15 bp, Artificial Sequence
  dgRNA
  Cytip
aataaagcggcataa

SEQ ID NO: 69118 - DNA, 15 bp, Artificial Sequence
  dgRNA
  Cytip
taggtgaatgtcaaa

SEQ ID NO: 69119 - DNA, 15 bp, Artificial Sequence
  dgRNA
  Cytip
aacggctacagctct

SEQ ID NO: 69120 - DNA, 15 bp, Artificial Sequence
  dgRNA
  Pole2
cagcccaagaatata

SEQ ID NO: 69121 - DNA, 15 bp, Artificial Sequence
  dgRNA
  Pole2
tataagggcgggaca

SEQ ID NO: 69122 - DNA, 15 bp, Artificial Sequence
  dgRNA
  Pole2
ataagggcgggacaa

SEQ ID NO: 69123 - DNA, 15 bp, Artificial Sequence
  dgRNA
  Pole2
taagggcgggacaag

SEQ ID NO: 69124 - DNA, 15 bp, Artificial Sequence
  dgRNA
  Gykl1
aacacaggaccgctg

SEQ ID NO: 69125 - DNA, 15 bp, Artificial Sequence
  dgRNA
  Gykl1
acacaggaccgctga

SEQ ID NO: 69126 - DNA, 15 bp, Artificial Sequence
  dgRNA
  Gykl1
tgatgacgtactgcc

SEQ ID NO: 69127 - DNA, 15 bp, Artificial Sequence
  dgRNA
  Gykl1
tcagccaatcaccta

SEQ ID NO: 69128 - DNA, 15 bp, Artificial Sequence
  dgRNA
  Rnf26
ataccgacatgctaa

SEQ ID NO: 69129 - DNA, 15 bp, Artificial Sequence
  dgRNA
  Rnf26
atcaccacttcaaag

SEQ ID NO: 69130 - DNA, 15 bp, Artificial Sequence
  dgRNA
  Rnf26
ttccacccctctcat

SEQ ID NO: 69131 - DNA, 15 bp, Artificial Sequence
  dgRNA
  Rnf26
ttgcccctcactgat

SEQ ID NO: 69132 - DNA, 15 bp, Artificial Sequence
  dgRNA
  Zfp84
agtagcaccgccttc

SEQ ID NO: 69133 - DNA, 15 bp, Artificial Sequence
  dgRNA
  Zfp84
gtagcaccgccttct

SEQ ID NO: 69134 - DNA, 15 bp, Artificial Sequence
  dgRNA
  Zfp84
tcggctctgtggtgg

SEQ ID NO: 69135 - DNA, 15 bp, Artificial Sequence
  dgRNA
  Zfp84
tttcggctctgtggt

SEQ ID NO: 69136 - DNA, 15 bp, Artificial Sequence
  dgRNA
  Pitx2
ccccgcagtggccca

SEQ ID NO: 69137 - DNA, 15 bp, Artificial Sequence
  dgRNA
  Pitx2
cgcccagcgtacagc

SEQ ID NO: 69138 - DNA, 15 bp, Artificial Sequence
  dgRNA
  Pitx2
agcgtacagcaggct

SEQ ID NO: 69139 - DNA, 15 bp, Artificial Sequence
  dgRNA
  Pitx2
cgcgccactgtgcac

SEQ ID NO: 69140 - DNA, 15 bp, Artificial Sequence
  dgRNA
  Bmyc
actgggcgaacgaag

SEQ ID NO: 69141 - DNA, 15 bp, Artificial Sequence
  dgRNA
  Bmyc
acgaagaggactgag

SEQ ID NO: 69142 - DNA, 15 bp, Artificial Sequence
  dgRNA
  Bmyc
gaggtagacactagc

SEQ ID NO: 69143 - DNA, 15 bp, Artificial Sequence
  dgRNA
  Bmyc
gagtatgcggagaat

SEQ ID NO: 69144 - DNA, 15 bp, Artificial Sequence
  dgRNA
  Fat4
cgttgcgcgacttac

SEQ ID NO: 69145 - DNA, 15 bp, Artificial Sequence
  dgRNA
  Fat4
ggtctctggccaaac

SEQ ID NO: 69146 - DNA, 15 bp, Artificial Sequence
  dgRNA
  Fat4
aaactggctttttac

SEQ ID NO: 69147 - DNA, 15 bp, Artificial Sequence
  dgRNA
  Fat4
gcgacggagcatccc

SEQ ID NO: 69148 - DNA, 15 bp, Artificial Sequence
  dgRNA
  Prdm15
gcccactcgcgggct

SEQ ID NO: 69149 - DNA, 15 bp, Artificial Sequence
  dgRNA
  Prdm15
cggcgccccccgccc

SEQ ID NO: 69150 - DNA, 15 bp, Artificial Sequence
  dgRNA
  Prdm15
gcccctagtgcgccc

SEQ ID NO: 69151 - DNA, 15 bp, Artificial Sequence
  dgRNA
  Prdm15
ccagcggccaccgcc

SEQ ID NO: 69152 - DNA, 15 bp, Artificial Sequence
  dgRNA
  Rtn4rl2
cgatggctccttccg

SEQ ID NO: 69153 - DNA, 15 bp, Artificial Sequence
  dgRNA
  Rtn4rl2
gctccttccgaggca

SEQ ID NO: 69154 - DNA, 15 bp, Artificial Sequence
  dgRNA
  Rtn4rl2
ccgaggcacggagtc

SEQ ID NO: 69155 - DNA, 15 bp, Artificial Sequence
  dgRNA
  Rtn4rl2
cgaggcacggagtcc

SEQ ID NO: 69156 - DNA, 15 bp, Artificial Sequence
  dgRNA
  Tac1
gacgggttaccgtct

SEQ ID NO: 69157 - DNA, 15 bp, Artificial Sequence
  dgRNA
  Tac1
catcacgcaagcgaa

SEQ ID NO: 69158 - DNA, 15 bp, Artificial Sequence
  dgRNA
  Tac1
cgcaagcgaaaggcg

SEQ ID NO: 69159 - DNA, 15 bp, Artificial Sequence
  dgRNA
  Tac1
gcaagcgaaaggcga

SEQ ID NO: 69160 - DNA, 15 bp, Artificial Sequence
  dgRNA
  Actl6b
ccatccgttgccctg

SEQ ID NO: 69161 - DNA, 15 bp, Artificial Sequence
  dgRNA
  Actl6b
ctcggaatgaagaag

SEQ ID NO: 69162 - DNA, 15 bp, Artificial Sequence
  dgRNA
  Actl6b
cgcttcataaccaat

SEQ ID NO: 69163 - DNA, 15 bp, Artificial Sequence
  dgRNA
  Actl6b
aatcggccgcgccgt

SEQ ID NO: 69164 - DNA, 15 bp, Artificial Sequence
  dgRNA
  Lin54
ccgccttccctttga

SEQ ID NO: 69165 - DNA, 15 bp, Artificial Sequence
  dgRNA
  Lin54
ccttccctttgacgg

SEQ ID NO: 69166 - DNA, 15 bp, Artificial Sequence
  dgRNA
  Lin54
tttgacggaggcccc

SEQ ID NO: 69167 - DNA, 15 bp, Artificial Sequence
  dgRNA
  Lin54
cgcaaagacgcgact

SEQ ID NO: 69168 - DNA, 15 bp, Artificial Sequence
  dgRNA
  Cyp2j5
tgaccataacctgcc

SEQ ID NO: 69169 - DNA, 15 bp, Artificial Sequence
  dgRNA
  Cyp2j5
gaatagaccacactg

SEQ ID NO: 69170 - DNA, 15 bp, Artificial Sequence
  dgRNA
  Cyp2j5
tcgtcaatatcgggt

SEQ ID NO: 69171 - DNA, 15 bp, Artificial Sequence
  dgRNA
  Cyp2j5
atcgtcaatatcggg

SEQ ID NO: 69172 - DNA, 15 bp, Artificial Sequence
  dgRNA
  Pvrl3
cctcggcagtggcat

SEQ ID NO: 69173 - DNA, 15 bp, Artificial Sequence
  dgRNA
  Pvrl3
cagtggcatcggcga

SEQ ID NO: 69174 - DNA, 15 bp, Artificial Sequence
  dgRNA
  Pvrl3
tggcatcggcgacgg

SEQ ID NO: 69175 - DNA, 15 bp, Artificial Sequence
  dgRNA
  Pvrl3
gcgacggcggagtcg

SEQ ID NO: 69176 - DNA, 15 bp, Artificial Sequence
  dgRNA
  Add3
gcggggccttgaagc

SEQ ID NO: 69177 - DNA, 15 bp, Artificial Sequence
  dgRNA
  Add3
agctggggtactaga

SEQ ID NO: 69178 - DNA, 15 bp, Artificial Sequence
  dgRNA
  Add3
gctggggtactagaa

SEQ ID NO: 69179 - DNA, 15 bp, Artificial Sequence
  dgRNA
  Add3
gggtcaagcctgtag

SEQ ID NO: 69180 - DNA, 15 bp, Artificial Sequence
  dgRNA
  Exosc5
agccctgagcaaaat

SEQ ID NO: 69181 - DNA, 15 bp, Artificial Sequence
  dgRNA
  Exosc5
tatgccagaattggg

SEQ ID NO: 69182 - DNA, 15 bp, Artificial Sequence
  dgRNA
  Exosc5
gctgagccacgtgct

SEQ ID NO: 69183 - DNA, 15 bp, Artificial Sequence
  dgRNA
  Exosc5
ctgagccacgtgcta

SEQ ID NO: 69184 - DNA, 15 bp, Artificial Sequence
  dgRNA
  Sirt6
ggttgtcgccttacg

SEQ ID NO: 69185 - DNA, 15 bp, Artificial Sequence
  dgRNA
  Sirt6
cgccttacgcggata

SEQ ID NO: 69186 - DNA, 15 bp, Artificial Sequence
  dgRNA
  Sirt6
gccttacgcggataa

SEQ ID NO: 69187 - DNA, 15 bp, Artificial Sequence
  dgRNA
  Sirt6
gataagggcaagtgc

SEQ ID NO: 69188 - DNA, 15 bp, Artificial Sequence
  dgRNA
  Ttl
acacactgagtggcg

SEQ ID NO: 69189 - DNA, 15 bp, Artificial Sequence
  dgRNA
  Ttl
cggggcggccctggt

SEQ ID NO: 69190 - DNA, 15 bp, Artificial Sequence
  dgRNA
  Ttl
gcccttagcgccgcg

SEQ ID NO: 69191 - DNA, 15 bp, Artificial Sequence
  dgRNA
  Ttl
cgccgcgcggaatca

SEQ ID NO: 69192 - DNA, 15 bp, Artificial Sequence
  dgRNA
  Sh3d21
agtcgaagcttcagg

SEQ ID NO: 69193 - DNA, 15 bp, Artificial Sequence
  dgRNA
  Sh3d21
gtcgaagcttcaggg

SEQ ID NO: 69194 - DNA, 15 bp, Artificial Sequence
  dgRNA
  Sh3d21
tcgaagcttcagggg

SEQ ID NO: 69195 - DNA, 15 bp, Artificial Sequence
  dgRNA
  Sh3d21
gctagtatctctatc

SEQ ID NO: 69196 - DNA, 15 bp, Artificial Sequence
  dgRNA
  Hist1h2be
gaatgtggtgttaac

SEQ ID NO: 69197 - DNA, 15 bp, Artificial Sequence
  dgRNA
  Hist1h2be
ggtgttaactggtga

SEQ ID NO: 69198 - DNA, 15 bp, Artificial Sequence
  dgRNA
  Hist1h2be
aactggtgacggagt

SEQ ID NO: 69199 - DNA, 15 bp, Artificial Sequence
  dgRNA
  Vwce
tcagattggattcta

SEQ ID NO: 69200 - DNA, 15 bp, Artificial Sequence
  dgRNA
  Vwce
gcgactcccaaaccc

SEQ ID NO: 69201 - DNA, 15 bp, Artificial Sequence
  dgRNA
  Vwce
gggggtgtgggccga

SEQ ID NO: 69202 - DNA, 15 bp, Artificial Sequence
  dgRNA
  Vwce
gtgaaaccccgccct

SEQ ID NO: 69203 - DNA, 15 bp, Artificial Sequence
  dgRNA
  Ooep
tctactagcctaccc

SEQ ID NO: 69204 - DNA, 15 bp, Artificial Sequence
  dgRNA
  Ooep
ctactagcctaccct

SEQ ID NO: 69205 - DNA, 15 bp, Artificial Sequence
  dgRNA
  Ooep
aattaagtagagcac

SEQ ID NO: 69206 - DNA, 15 bp, Artificial Sequence
  dgRNA
  Ooep
gtgtcagcagtatcc

SEQ ID NO: 69207 - DNA, 15 bp, Artificial Sequence
  dgRNA
  Cyp4f18
aagtccttacacaag

SEQ ID NO: 69208 - DNA, 15 bp, Artificial Sequence
  dgRNA
  Cyp4f18
gggtgtgaagtcccg

SEQ ID NO: 69209 - DNA, 15 bp, Artificial Sequence
  dgRNA
  Cyp4f18
tccgcccccacatga

SEQ ID NO: 69210 - DNA, 15 bp, Artificial Sequence
  dgRNA
  Cyp4f18
gccacctatccaggc

SEQ ID NO: 69211 - DNA, 15 bp, Artificial Sequence
  dgRNA
  Rgs18
ctctgcgggcttgaa

SEQ ID NO: 69212 - DNA, 15 bp, Artificial Sequence
  dgRNA
  Rgs18
tctgcgggcttgaaa

SEQ ID NO: 69213 - DNA, 15 bp, Artificial Sequence
  dgRNA
  Rgs18
agggaagtaacgctg

SEQ ID NO: 69214 - DNA, 15 bp, Artificial Sequence
  dgRNA
  Rgs18
caagcccgcagagaa

SEQ ID NO: 69215 - DNA, 15 bp, Artificial Sequence
  dgRNA
  Ccdc8
taagcctgataatag

SEQ ID NO: 69216 - DNA, 15 bp, Artificial Sequence
  dgRNA
  Ccdc8
acatatatcaggcat

SEQ ID NO: 69217 - DNA, 15 bp, Artificial Sequence
  dgRNA
  Ccdc8
aacaacggccaggta

SEQ ID NO: 69218 - DNA, 15 bp, Artificial Sequence
  dgRNA
  Ccdc8
taggccactattatc

SEQ ID NO: 69219 - DNA, 15 bp, Artificial Sequence
  dgRNA
  Usp17lb
cacccaacttgggag

SEQ ID NO: 69220 - DNA, 15 bp, Artificial Sequence
  dgRNA
  Usp17lb
ttctaagggatcagc

SEQ ID NO: 69221 - DNA, 15 bp, Artificial Sequence
  dgRNA
  Apoa2
actcctgatcccaaa

SEQ ID NO: 69222 - DNA, 15 bp, Artificial Sequence
  dgRNA
  Apoa2
gagtttatgcccctg

SEQ ID NO: 69223 - DNA, 15 bp, Artificial Sequence
  dgRNA
  Apoa2
ctccgtatcacctga

SEQ ID NO: 69224 - DNA, 15 bp, Artificial Sequence
  dgRNA
  Apoa2
tccgtatcacctgac

SEQ ID NO: 69225 - DNA, 15 bp, Artificial Sequence
  dgRNA
  Tmem5
aagctatgggtgcgg

SEQ ID NO: 69226 - DNA, 15 bp, Artificial Sequence
  dgRNA
  Tmem5
ctatgggtgcggagg

SEQ ID NO: 69227 - DNA, 15 bp, Artificial Sequence
  dgRNA
  Tmem5
gagagactagttgtg

SEQ ID NO: 69228 - DNA, 15 bp, Artificial Sequence
  dgRNA
  Tmem5
agactagttgtgagg

SEQ ID NO: 69229 - DNA, 15 bp, Artificial Sequence
  dgRNA
  Tnrc6c
gcctctgagcgaagg

SEQ ID NO: 69230 - DNA, 15 bp, Artificial Sequence
  dgRNA
  Tnrc6c
cctctgagcgaagga

SEQ ID NO: 69231 - DNA, 15 bp, Artificial Sequence
  dgRNA
  Tnrc6c
ctctgagcgaaggag

SEQ ID NO: 69232 - DNA, 15 bp, Artificial Sequence
  dgRNA
  Tnrc6c
tctgagcgaaggagg

SEQ ID NO: 69233 - DNA, 15 bp, Artificial Sequence
  dgRNA
  Lipn
gccaaaatgattact

SEQ ID NO: 69234 - DNA, 15 bp, Artificial Sequence
  dgRNA
  Lipn
tgcatttggtgcgct

SEQ ID NO: 69235 - DNA, 15 bp, Artificial Sequence
  dgRNA
  Lipn
gcatttggtgcgcta

SEQ ID NO: 69236 - DNA, 15 bp, Artificial Sequence
  dgRNA
  Lipn
gctagggagccgcct

SEQ ID NO: 69237 - DNA, 15 bp, Artificial Sequence
  dgRNA
  Sycp1
tgagacgcctttaaa

SEQ ID NO: 69238 - DNA, 15 bp, Artificial Sequence
  dgRNA
  Sycp1
ggctatacaccaacg

SEQ ID NO: 69239 - DNA, 15 bp, Artificial Sequence
  dgRNA
  Sycp1
gctatacaccaacga

SEQ ID NO: 69240 - DNA, 15 bp, Artificial Sequence
  dgRNA
  Sycp1
ctatacaccaacgag

SEQ ID NO: 69241 - DNA, 15 bp, Artificial Sequence
  dgRNA
  Proser2
gccgagagcgcgcgg

SEQ ID NO: 69242 - DNA, 15 bp, Artificial Sequence
  dgRNA
  Proser2
ccgagagcgcgcggc

SEQ ID NO: 69243 - DNA, 15 bp, Artificial Sequence
  dgRNA
  Proser2
gtgctggacgccctg

SEQ ID NO: 69244 - DNA, 15 bp, Artificial Sequence
  dgRNA
  Proser2
tggggagcgcgctcc

SEQ ID NO: 69245 - DNA, 15 bp, Artificial Sequence
  dgRNA
  Bok
gggacagctccagtc

SEQ ID NO: 69246 - DNA, 15 bp, Artificial Sequence
  dgRNA
  Bok
gtctggcggcgttcc

SEQ ID NO: 69247 - DNA, 15 bp, Artificial Sequence
  dgRNA
  Bok
tctggcggcgttccc

SEQ ID NO: 69248 - DNA, 15 bp, Artificial Sequence
  dgRNA
  Bok
cccgagaacttgtgc

SEQ ID NO: 69249 - DNA, 15 bp, Artificial Sequence
  dgRNA
  Tmem136
gtgcccctagacccc

SEQ ID NO: 69250 - DNA, 15 bp, Artificial Sequence
  dgRNA
  Tmem136
gtagctttttagtgg

SEQ ID NO: 69251 - DNA, 15 bp, Artificial Sequence
  dgRNA
  Tmem136
agtgtagctttttag

SEQ ID NO: 69252 - DNA, 15 bp, Artificial Sequence
  dgRNA
  Tmem136
gtcctcctttggata

SEQ ID NO: 69253 - DNA, 15 bp, Artificial Sequence
  dgRNA
  Wdr75
tggcgtagatgctac

SEQ ID NO: 69254 - DNA, 15 bp, Artificial Sequence
  dgRNA
  Wdr75
gcaacggaggggggt

SEQ ID NO: 69255 - DNA, 15 bp, Artificial Sequence
  dgRNA
  Wdr75
tttagctctttatgg

SEQ ID NO: 69256 - DNA, 15 bp, Artificial Sequence
  dgRNA
  Wdr75
cgctttagctcttta

SEQ ID NO: 69257 - DNA, 15 bp, Artificial Sequence
  dgRNA
  Ly6g6c
gggcacaggcccgga

SEQ ID NO: 69258 - DNA, 15 bp, Artificial Sequence
  dgRNA
  Ly6g6c
ggcacaggcccggaa

SEQ ID NO: 69259 - DNA, 15 bp, Artificial Sequence
  dgRNA
  Ly6g6c
tgggcaactccattt

SEQ ID NO: 69260 - DNA, 15 bp, Artificial Sequence
  dgRNA
  Map3k2
tggaaacggcgcagt

SEQ ID NO: 69261 - DNA, 15 bp, Artificial Sequence
  dgRNA
  Map3k2
aaacggcgcagtcgg

SEQ ID NO: 69262 - DNA, 15 bp, Artificial Sequence
  dgRNA
  Map3k2
gcgcagtcggcggtg

SEQ ID NO: 69263 - DNA, 15 bp, Artificial Sequence
  dgRNA
  Map3k2
cagtcggcggtgagg

SEQ ID NO: 69264 - DNA, 15 bp, Artificial Sequence
  dgRNA
  Slc23a2
agcgtcgagcatcct

SEQ ID NO: 69265 - DNA, 15 bp, Artificial Sequence
  dgRNA
  Slc23a2
gtcgagcatcctagg

SEQ ID NO: 69266 - DNA, 15 bp, Artificial Sequence
  dgRNA
  Slc23a2
cctaggcggcccccc

SEQ ID NO: 69267 - DNA, 15 bp, Artificial Sequence
  dgRNA
  Slc23a2
cggcccccccggagc

SEQ ID NO: 69268 - DNA, 15 bp, Artificial Sequence
  dgRNA
  Tas2r136
catccattagcacac

SEQ ID NO: 69269 - DNA, 15 bp, Artificial Sequence
  dgRNA
  Tas2r136
ggatgaatatggtac

SEQ ID NO: 69270 - DNA, 15 bp, Artificial Sequence
  dgRNA
  Homer1
tctgctccgagtctt

SEQ ID NO: 69271 - DNA, 15 bp, Artificial Sequence
  dgRNA
  Homer1
gctccgagtcttagg

SEQ ID NO: 69272 - DNA, 15 bp, Artificial Sequence
  dgRNA
  Homer1
aggacgaacattcaa

SEQ ID NO: 69273 - DNA, 15 bp, Artificial Sequence
  dgRNA
  Homer1
tgtgccgtgcacatc

SEQ ID NO: 69274 - DNA, 15 bp, Artificial Sequence
  dgRNA
  Efcab12
cctgacttccgggtt

SEQ ID NO: 69275 - DNA, 15 bp, Artificial Sequence
  dgRNA
  Efcab12
acttccgggtttggg

SEQ ID NO: 69276 - DNA, 15 bp, Artificial Sequence
  dgRNA
  Efcab12
cctccttcttgcaag

SEQ ID NO: 69277 - DNA, 15 bp, Artificial Sequence
  dgRNA
  Efcab12
aagcgctcagccaat

SEQ ID NO: 69278 - DNA, 15 bp, Artificial Sequence
  dgRNA
  Olfr1229
catcaaaccataaac

SEQ ID NO: 69279 - DNA, 15 bp, Artificial Sequence
  dgRNA
  Olfr1229
cttcaatccagttta

SEQ ID NO: 69280 - DNA, 15 bp, Artificial Sequence
  dgRNA
  Erg
gattgtgctaagtct

SEQ ID NO: 69281 - DNA, 15 bp, Artificial Sequence
  dgRNA
  Erg
agattgtgctaagtc

SEQ ID NO: 69282 - DNA, 15 bp, Artificial Sequence
  dgRNA
  Def8
gcatgcaatcgccac

SEQ ID NO: 69283 - DNA, 15 bp, Artificial Sequence
  dgRNA
  Def8
gcaatcgccactggt

SEQ ID NO: 69284 - DNA, 15 bp, Artificial Sequence
  dgRNA
  Def8
ccactggtcggactc

SEQ ID NO: 69285 - DNA, 15 bp, Artificial Sequence
  dgRNA
  Def8
cactggtcggactcc

SEQ ID NO: 69286 - DNA, 15 bp, Artificial Sequence
  dgRNA
  Capn5
caaacaggactggtc

SEQ ID NO: 69287 - DNA, 15 bp, Artificial Sequence
  dgRNA
  Capn5
atataccaggccctc

SEQ ID NO: 69288 - DNA, 15 bp, Artificial Sequence
  dgRNA
  Capn5
gaaaggcaatatacc

SEQ ID NO: 69289 - DNA, 15 bp, Artificial Sequence
  dgRNA
  Phldb2
gtggccgcctgcatt

SEQ ID NO: 69290 - DNA, 15 bp, Artificial Sequence
  dgRNA
  Phldb2
ccaccttatcgcccc

SEQ ID NO: 69291 - DNA, 15 bp, Artificial Sequence
  dgRNA
  Phldb2
gccccaggtgagtag

SEQ ID NO: 69292 - DNA, 15 bp, Artificial Sequence
  dgRNA
  Phldb2
ccccaggtgagtagt

SEQ ID NO: 69293 - DNA, 15 bp, Artificial Sequence
  dgRNA
  Olfr1504
aacttaatactagat

SEQ ID NO: 69294 - DNA, 15 bp, Artificial Sequence
  dgRNA
  Olfr1504
atttttgtgctatgc

SEQ ID NO: 69295 - DNA, 15 bp, Artificial Sequence
  dgRNA
  Olfr1504
gtattaagtttctca

SEQ ID NO: 69296 - DNA, 15 bp, Artificial Sequence
  dgRNA
  Hoxa4
ggatcgcagcacgtg

SEQ ID NO: 69297 - DNA, 15 bp, Artificial Sequence
  dgRNA
  Hoxa4
gcagcacgtggggcg

SEQ ID NO: 69298 - DNA, 15 bp, Artificial Sequence
  dgRNA
  Hoxa4
cagcacgtggggcgc

SEQ ID NO: 69299 - DNA, 15 bp, Artificial Sequence
  dgRNA
  Hoxa4
agcacgtggggcgcg

SEQ ID NO: 69300 - DNA, 15 bp, Artificial Sequence
  dgRNA
  Ildr2
acatggtccgccctc

SEQ ID NO: 69301 - DNA, 15 bp, Artificial Sequence
  dgRNA
  Ildr2
catggtccgccctct

SEQ ID NO: 69302 - DNA, 15 bp, Artificial Sequence
  dgRNA
  Ildr2
gtccgccctctgggg

SEQ ID NO: 69303 - DNA, 15 bp, Artificial Sequence
  dgRNA
  Ildr2
gtggacttcgctgct

SEQ ID NO: 69304 - DNA, 15 bp, Artificial Sequence
  dgRNA
  Slc39a12
ggctcgcagatttgc

SEQ ID NO: 69305 - DNA, 15 bp, Artificial Sequence
  dgRNA
  Slc39a12
aaagcggacagttgc

SEQ ID NO: 69306 - DNA, 15 bp, Artificial Sequence
  dgRNA
  Slc39a12
cggtaagaatgaagg

SEQ ID NO: 69307 - DNA, 15 bp, Artificial Sequence
  dgRNA
  Slc39a12
agacggtaagaatga

SEQ ID NO: 69308 - DNA, 15 bp, Artificial Sequence
  dgRNA
  Zfp688
cccttgcggccagta

SEQ ID NO: 69309 - DNA, 15 bp, Artificial Sequence
  dgRNA
  Zfp688
gcaactgtgaccaag

SEQ ID NO: 69310 - DNA, 15 bp, Artificial Sequence
  dgRNA
  Zfp688
ccaaggggcgtgcca

SEQ ID NO: 69311 - DNA, 15 bp, Artificial Sequence
  dgRNA
  Zfp688
caaggggcgtgccaa

SEQ ID NO: 69312 - DNA, 15 bp, Artificial Sequence
  dgRNA
  Klf5
tgcgcgcgaagctcc

SEQ ID NO: 69313 - DNA, 15 bp, Artificial Sequence
  dgRNA
  Klf5
agctcctggcccgcg

SEQ ID NO: 69314 - DNA, 15 bp, Artificial Sequence
  dgRNA
  Klf5
gctcctggcccgcga

SEQ ID NO: 69315 - DNA, 15 bp, Artificial Sequence
  dgRNA
  Klf5
ctcctggcccgcgag

SEQ ID NO: 69316 - DNA, 15 bp, Artificial Sequence
  dgRNA
  Klra8
ttcgatttggtcaag

SEQ ID NO: 69317 - DNA, 15 bp, Artificial Sequence
  dgRNA
  Osbpl8
agcagaagctacccg

SEQ ID NO: 69318 - DNA, 15 bp, Artificial Sequence
  dgRNA
  Osbpl8
gggaccgcctccttg

SEQ ID NO: 69319 - DNA, 15 bp, Artificial Sequence
  dgRNA
  Osbpl8
tgcggcgtcacgtga

SEQ ID NO: 69320 - DNA, 15 bp, Artificial Sequence
  dgRNA
  Osbpl8
gcggcgtcacgtgac

SEQ ID NO: 69321 - DNA, 15 bp, Artificial Sequence
  dgRNA
  Tfap2c
gcccctcgcgacgcc

SEQ ID NO: 69322 - DNA, 15 bp, Artificial Sequence
  dgRNA
  Tfap2c
gtcctgcaacacgct

SEQ ID NO: 69323 - DNA, 15 bp, Artificial Sequence
  dgRNA
  Tfap2c
tgcaacacgctaggc

SEQ ID NO: 69324 - DNA, 15 bp, Artificial Sequence
  dgRNA
  Tfap2c
gcaacacgctaggca

SEQ ID NO: 69325 - DNA, 15 bp, Artificial Sequence
  dgRNA
  Olfr694
tcttaagaggcatac

SEQ ID NO: 69326 - DNA, 15 bp, Artificial Sequence
  dgRNA
  Olfr694
cttaagaggcatact

SEQ ID NO: 69327 - DNA, 15 bp, Artificial Sequence
  dgRNA
  Olfr694
actgggtaacataag

SEQ ID NO: 69328 - DNA, 15 bp, Artificial Sequence
  dgRNA
  Casp1
cgtgtttctgctgca

SEQ ID NO: 69329 - DNA, 15 bp, Artificial Sequence
  dgRNA
  Casp1
acgtgtttctgctgc

SEQ ID NO: 69330 - DNA, 15 bp, Artificial Sequence
  dgRNA
  Casp1
tgtgacaacaagtcc

SEQ ID NO: 69331 - DNA, 15 bp, Artificial Sequence
  dgRNA
  Rab39
gctgctctgcaagtt

SEQ ID NO: 69332 - DNA, 15 bp, Artificial Sequence
  dgRNA
  Rab39
tcccttccaaactcg

SEQ ID NO: 69333 - DNA, 15 bp, Artificial Sequence
  dgRNA
  Rab39
cacgccccctgcccg

SEQ ID NO: 69334 - DNA, 15 bp, Artificial Sequence
  dgRNA
  Rab39
ggccccagctgtaag

SEQ ID NO: 69335 - DNA, 15 bp, Artificial Sequence
  dgRNA
  Mttp
gccggtggggaacgc

SEQ ID NO: 69336 - DNA, 15 bp, Artificial Sequence
  dgRNA
  Mttp
ccggtggggaacgcc

SEQ ID NO: 69337 - DNA, 15 bp, Artificial Sequence
  dgRNA
  Mttp
cggtggggaacgccg

SEQ ID NO: 69338 - DNA, 15 bp, Artificial Sequence
  dgRNA
  Mttp
gttctcggctccacg

SEQ ID NO: 69339 - DNA, 15 bp, Artificial Sequence
  dgRNA
  Fbl
gctagcataagtgag

SEQ ID NO: 69340 - DNA, 15 bp, Artificial Sequence
  dgRNA
  Fbl
aaaatttgccactct

SEQ ID NO: 69341 - DNA, 15 bp, Artificial Sequence
  dgRNA
  Fbl
gagacacgacagagc

SEQ ID NO: 69342 - DNA, 15 bp, Artificial Sequence
  dgRNA
  Fbl
cgacagagccggaaa

SEQ ID NO: 69343 - DNA, 15 bp, Artificial Sequence
  dgRNA
  Emc10
ttcatcgccacgccc

SEQ ID NO: 69344 - DNA, 15 bp, Artificial Sequence
  dgRNA
  Emc10
ccacgccccggccct

SEQ ID NO: 69345 - DNA, 15 bp, Artificial Sequence
  dgRNA
  Emc10
cacgccccggccctg

SEQ ID NO: 69346 - DNA, 15 bp, Artificial Sequence
  dgRNA
  Emc10
acgccgagtgaagcc

SEQ ID NO: 69347 - DNA, 15 bp, Artificial Sequence
  dgRNA
  Sh2d1b2
gaaccacctacctct

SEQ ID NO: 69348 - DNA, 15 bp, Artificial Sequence
  dgRNA
  Sh2d1b2
gacacttcagcctag

SEQ ID NO: 69349 - DNA, 15 bp, Artificial Sequence
  dgRNA
  Sh2d1b2
agctttacacgactc

SEQ ID NO: 69350 - DNA, 15 bp, Artificial Sequence
  dgRNA
  Dazl
aggctcgggcctgct

SEQ ID NO: 69351 - DNA, 15 bp, Artificial Sequence
  dgRNA
  Dazl
ccctcacgcactccg

SEQ ID NO: 69352 - DNA, 15 bp, Artificial Sequence
  dgRNA
  Dazl
cctcacgcactccgt

SEQ ID NO: 69353 - DNA, 15 bp, Artificial Sequence
  dgRNA
  Dazl
actccgtgggcgacg

SEQ ID NO: 69354 - DNA, 15 bp, Artificial Sequence
  dgRNA
  Cdv3
tagccgagcgctcgc

SEQ ID NO: 69355 - DNA, 15 bp, Artificial Sequence
  dgRNA
  Cdv3
tcgcggttcccagcg

SEQ ID NO: 69356 - DNA, 15 bp, Artificial Sequence
  dgRNA
  Cdv3
gcaccggcgagcgct

SEQ ID NO: 69357 - DNA, 15 bp, Artificial Sequence
  dgRNA
  Cdv3
aaggaaggcgcgcac

SEQ ID NO: 69358 - DNA, 15 bp, Artificial Sequence
  dgRNA
  Sptlc1
cgctatacaagtctc

SEQ ID NO: 69359 - DNA, 15 bp, Artificial Sequence
  dgRNA
  Sptlc1
gctatacaagtctca

SEQ ID NO: 69360 - DNA, 15 bp, Artificial Sequence
  dgRNA
  Sptlc1
gagcacacccgaacg

SEQ ID NO: 69361 - DNA, 15 bp, Artificial Sequence
  dgRNA
  Sptlc1
cacacccgaacgagg

SEQ ID NO: 69362 - DNA, 15 bp, Artificial Sequence
  dgRNA
  Xrn2
gctgcgggcctaatg

SEQ ID NO: 69363 - DNA, 15 bp, Artificial Sequence
  dgRNA
  Xrn2
cgggcctaatgtggc

SEQ ID NO: 69364 - DNA, 15 bp, Artificial Sequence
  dgRNA
  Xrn2
tgtggccggcgctct

SEQ ID NO: 69365 - DNA, 15 bp, Artificial Sequence
  dgRNA
  Xrn2
gccggcgctcttggc

SEQ ID NO: 69366 - DNA, 15 bp, Artificial Sequence
  dgRNA
  Acy3
agttctccgcctact

SEQ ID NO: 69367 - DNA, 15 bp, Artificial Sequence
  dgRNA
  Acy3
aaatacagcctccta

SEQ ID NO: 69368 - DNA, 15 bp, Artificial Sequence
  dgRNA
  Acy3
gggggtggacacatt

SEQ ID NO: 69369 - DNA, 15 bp, Artificial Sequence
  dgRNA
  Acy3
gacacattaggcctg

SEQ ID NO: 69370 - DNA, 15 bp, Artificial Sequence
  dgRNA
  Rbfox3
tgcttattggcagta

SEQ ID NO: 69371 - DNA, 15 bp, Artificial Sequence
  dgRNA
  Rbfox3
tcctaaatttggctg

SEQ ID NO: 69372 - DNA, 15 bp, Artificial Sequence
  dgRNA
  Mgat5
ccttgggctgcggaa

SEQ ID NO: 69373 - DNA, 15 bp, Artificial Sequence
  dgRNA
  Mgat5
ggctgcggaatggag

SEQ ID NO: 69374 - DNA, 15 bp, Artificial Sequence
  dgRNA
  Mgat5
aagtcctcctgtaca

SEQ ID NO: 69375 - DNA, 15 bp, Artificial Sequence
  dgRNA
  Mgat5
atccccgagaagccg

SEQ ID NO: 69376 - DNA, 15 bp, Artificial Sequence
  dgRNA
  Sec22a
tagccttatttccga

SEQ ID NO: 69377 - DNA, 15 bp, Artificial Sequence
  dgRNA
  Sec22a
gagaaggcaatctcc

SEQ ID NO: 69378 - DNA, 15 bp, Artificial Sequence
  dgRNA
  Sec22a
gcaatctcctggcgc

SEQ ID NO: 69379 - DNA, 15 bp, Artificial Sequence
  dgRNA
  Sec22a
tcctggcgcaggtgc

SEQ ID NO: 69380 - DNA, 15 bp, Artificial Sequence
  dgRNA
  Rusc2
gaggctcgctgcctc

SEQ ID NO: 69381 - DNA, 15 bp, Artificial Sequence
  dgRNA
  Rusc2
tgcctcgggcgaagc

SEQ ID NO: 69382 - DNA, 15 bp, Artificial Sequence
  dgRNA
  Rusc2
gcctcgggcgaagct

SEQ ID NO: 69383 - DNA, 15 bp, Artificial Sequence
  dgRNA
  Rusc2
cctcgggcgaagctg

SEQ ID NO: 69384 - DNA, 15 bp, Artificial Sequence
  dgRNA
  Prlh
ctgtacaaacaacct

SEQ ID NO: 69385 - DNA, 15 bp, Artificial Sequence
  dgRNA
  Prlh
acctagggtccctcc

SEQ ID NO: 69386 - DNA, 15 bp, Artificial Sequence
  dgRNA
  Prlh
caggatccaatctcc

SEQ ID NO: 69387 - DNA, 15 bp, Artificial Sequence
  dgRNA
  Prlh
aggatccaatctcca

SEQ ID NO: 69388 - DNA, 15 bp, Artificial Sequence
  dgRNA
  Epha1
ctagcaacacccact

SEQ ID NO: 69389 - DNA, 15 bp, Artificial Sequence
  dgRNA
  Epha1
gcaacacccactagg

SEQ ID NO: 69390 - DNA, 15 bp, Artificial Sequence
  dgRNA
  Epha1
ccgcccccgcctagc

SEQ ID NO: 69391 - DNA, 15 bp, Artificial Sequence
  dgRNA
  Epha1
cccgcctagccggcc

SEQ ID NO: 69392 - DNA, 15 bp, Artificial Sequence
  dgRNA
  Tmprss11d
cttaccagaataaat

SEQ ID NO: 69393 - DNA, 15 bp, Artificial Sequence
  dgRNA
  Tmprss11d
atgactctaggtggc

SEQ ID NO: 69394 - DNA, 15 bp, Artificial Sequence
  dgRNA
  Tmprss11d
caatagtgtgacttg

SEQ ID NO: 69395 - DNA, 15 bp, Artificial Sequence
  dgRNA
  Kcnab2
cctgaggcctcttcg

SEQ ID NO: 69396 - DNA, 15 bp, Artificial Sequence
  dgRNA
  Kcnab2
gacttcccccgcact

SEQ ID NO: 69397 - DNA, 15 bp, Artificial Sequence
  dgRNA
  Kcnab2
gctggcgcgttacct

SEQ ID NO: 69398 - DNA, 15 bp, Artificial Sequence
  dgRNA
  Kcnab2
gcgttacctaggaga

SEQ ID NO: 69399 - DNA, 15 bp, Artificial Sequence
  dgRNA
  Peg3
gtcaactccgtgcct

SEQ ID NO: 69400 - DNA, 15 bp, Artificial Sequence
  dgRNA
  Peg3
gcagtctgattggca

SEQ ID NO: 69401 - DNA, 15 bp, Artificial Sequence
  dgRNA
  Peg3
ggtgagggcccaaag

SEQ ID NO: 69402 - DNA, 15 bp, Artificial Sequence
  dgRNA
  Peg3
tgagggcccaaagcg

SEQ ID NO: 69403 - DNA, 15 bp, Artificial Sequence
  dgRNA
  Guk1
tgtaggcgcagatct

SEQ ID NO: 69404 - DNA, 15 bp, Artificial Sequence
  dgRNA
  Guk1
gtaggcgcagatctc

SEQ ID NO: 69405 - DNA, 15 bp, Artificial Sequence
  dgRNA
  Guk1
gcagatctcgggagc

SEQ ID NO: 69406 - DNA, 15 bp, Artificial Sequence
  dgRNA
  Guk1
agggctggtgcccga

SEQ ID NO: 69407 - DNA, 15 bp, Artificial Sequence
  dgRNA
  Slc41a2
tgaaccgcacatagt

SEQ ID NO: 69408 - DNA, 15 bp, Artificial Sequence
  dgRNA
  Slc41a2
gcccccgattttcct

SEQ ID NO: 69409 - DNA, 15 bp, Artificial Sequence
  dgRNA
  Slc41a2
cccaaaactcgagcg

SEQ ID NO: 69410 - DNA, 15 bp, Artificial Sequence
  dgRNA
  Slc41a2
ccaaaactcgagcgt

SEQ ID NO: 69411 - DNA, 15 bp, Artificial Sequence
  dgRNA
  Ppm1a
acgtccacgctccct

SEQ ID NO: 69412 - DNA, 15 bp, Artificial Sequence
  dgRNA
  Ppm1a
cgtccacgctcccta

SEQ ID NO: 69413 - DNA, 15 bp, Artificial Sequence
  dgRNA
  Ppm1a
acgctccctagggat

SEQ ID NO: 69414 - DNA, 15 bp, Artificial Sequence
  dgRNA
  Ppm1a
ctagggatcggcccg

SEQ ID NO: 69415 - DNA, 15 bp, Artificial Sequence
  dgRNA
  Cmc2
gtctcgaattccacc

SEQ ID NO: 69416 - DNA, 15 bp, Artificial Sequence
  dgRNA
  Cmc2
cccgccgagccccgg

SEQ ID NO: 69417 - DNA, 15 bp, Artificial Sequence
  dgRNA
  Cmc2
ccgccgagccccggt

SEQ ID NO: 69418 - DNA, 15 bp, Artificial Sequence
  dgRNA
  Cmc2
cgagccccggtggga

SEQ ID NO: 69419 - DNA, 15 bp, Artificial Sequence
  dgRNA
  Vmn1r83
tgcaccattatatcc

SEQ ID NO: 69420 - DNA, 15 bp, Artificial Sequence
  dgRNA
  Chst15
actgtttctggtagc

SEQ ID NO: 69421 - DNA, 15 bp, Artificial Sequence
  dgRNA
  Chst15
ttacttgctgggcga

SEQ ID NO: 69422 - DNA, 15 bp, Artificial Sequence
  dgRNA
  Chst15
tacttgctgggcgag

SEQ ID NO: 69423 - DNA, 15 bp, Artificial Sequence
  dgRNA
  Chst15
aacccaccgctcagc

SEQ ID NO: 69424 - DNA, 15 bp, Artificial Sequence
  dgRNA
  H2afy2
acacagtaacgtgtt

SEQ ID NO: 69425 - DNA, 15 bp, Artificial Sequence
  dgRNA
  H2afy2
gggctgcatccaacg

SEQ ID NO: 69426 - DNA, 15 bp, Artificial Sequence
  dgRNA
  H2afy2
cttctcatcccgtaa

SEQ ID NO: 69427 - DNA, 15 bp, Artificial Sequence
  dgRNA
  H2afy2
ttctcatcccgtaat

SEQ ID NO: 69428 - DNA, 15 bp, Artificial Sequence
  dgRNA
  Gkn3
taagtccttacacag

SEQ ID NO: 69429 - DNA, 15 bp, Artificial Sequence
  dgRNA
  Gkn3
ctcggatctagtaaa

SEQ ID NO: 69430 - DNA, 15 bp, Artificial Sequence
  dgRNA
  Gkn3
tagctttccccctaa

SEQ ID NO: 69431 - DNA, 15 bp, Artificial Sequence
  dgRNA
  Gkn3
gctcggcaggttcca

SEQ ID NO: 69432 - DNA, 15 bp, Artificial Sequence
  dgRNA
  Arpp21
ccgggtggggcggtc

SEQ ID NO: 69433 - DNA, 15 bp, Artificial Sequence
  dgRNA
  Arpp21
tcgggagcaccactg

SEQ ID NO: 69434 - DNA, 15 bp, Artificial Sequence
  dgRNA
  Arpp21
gctggctgactccgg

SEQ ID NO: 69435 - DNA, 15 bp, Artificial Sequence
  dgRNA
  Arpp21
ctggctgactccggc

SEQ ID NO: 69436 - DNA, 15 bp, Artificial Sequence
  dgRNA
  Haus2
tcgcgccagttccag

SEQ ID NO: 69437 - DNA, 15 bp, Artificial Sequence
  dgRNA
  Haus2
ggtgtgcggaagcca

SEQ ID NO: 69438 - DNA, 15 bp, Artificial Sequence
  dgRNA
  Haus2
gcggccgccaacccg

SEQ ID NO: 69439 - DNA, 15 bp, Artificial Sequence
  dgRNA
  Haus2
cggccgccaacccgt

SEQ ID NO: 69440 - DNA, 15 bp, Artificial Sequence
  dgRNA
  Wbscr22
gtgtatcgtcccagc

SEQ ID NO: 69441 - DNA, 15 bp, Artificial Sequence
  dgRNA
  Wbscr22
cgaagggcttccctc

SEQ ID NO: 69442 - DNA, 15 bp, Artificial Sequence
  dgRNA
  Wbscr22
tctccgtagtgcgcc

SEQ ID NO: 69443 - DNA, 15 bp, Artificial Sequence
  dgRNA
  Wbscr22
agtgcgcctggtaga

SEQ ID NO: 69444 - DNA, 15 bp, Artificial Sequence
  dgRNA
  Ank1
cctgagccgtttggc

SEQ ID NO: 69445 - DNA, 15 bp, Artificial Sequence
  dgRNA
  Ank1
agccgtttggcagga

SEQ ID NO: 69446 - DNA, 15 bp, Artificial Sequence
  dgRNA
  Ank1
ctaagagagtcgcgc

SEQ ID NO: 69447 - DNA, 15 bp, Artificial Sequence
  dgRNA
  Ank1
cctgccaaacggctc

SEQ ID NO: 69448 - DNA, 15 bp, Artificial Sequence
  dgRNA
  Olfml1
agctaggcctgcgat

SEQ ID NO: 69449 - DNA, 15 bp, Artificial Sequence
  dgRNA
  Olfml1
ctgcacagtctatta

SEQ ID NO: 69450 - DNA, 15 bp, Artificial Sequence
  dgRNA
  Olfml1
agtctattaaggagg

SEQ ID NO: 69451 - DNA, 15 bp, Artificial Sequence
  dgRNA
  Olfml1
gtctattaaggagga

SEQ ID NO: 69452 - DNA, 15 bp, Artificial Sequence
  dgRNA
  Ccdc89
gtagcctgaccagat

SEQ ID NO: 69453 - DNA, 15 bp, Artificial Sequence
  dgRNA
  Ccdc89
ctcactgcgttctgc

SEQ ID NO: 69454 - DNA, 15 bp, Artificial Sequence
  dgRNA
  Ccdc89
ctgtccaccaattat

SEQ ID NO: 69455 - DNA, 15 bp, Artificial Sequence
  dgRNA
  Ccdc89
tataggactccttac

SEQ ID NO: 69456 - DNA, 15 bp, Artificial Sequence
  dgRNA
  Btnl4
cttacctcctgccgc

SEQ ID NO: 69457 - DNA, 15 bp, Artificial Sequence
  dgRNA
  Btnl4
ttacctcctgccgca

SEQ ID NO: 69458 - DNA, 15 bp, Artificial Sequence
  dgRNA
  Btnl4
gatccacccagatct

SEQ ID NO: 69459 - DNA, 15 bp, Artificial Sequence
  dgRNA
  Btnl4
acaccctgcggcagg

SEQ ID NO: 69460 - DNA, 15 bp, Artificial Sequence
  dgRNA
  Tshz2
tctccggccccgcgc

SEQ ID NO: 69461 - DNA, 15 bp, Artificial Sequence
  dgRNA
  Tshz2
cccgcgctggagcgc

SEQ ID NO: 69462 - DNA, 15 bp, Artificial Sequence
  dgRNA
  Tshz2
cgctggagcgctggc

SEQ ID NO: 69463 - DNA, 15 bp, Artificial Sequence
  dgRNA
  Tshz2
tggagcgctggcagg

SEQ ID NO: 69464 - DNA, 15 bp, Artificial Sequence
  dgRNA
  Arhgef26
aagagatcaggtggt

SEQ ID NO: 69465 - DNA, 15 bp, Artificial Sequence
  dgRNA
  Arhgef26
gtggttggggaaatc

SEQ ID NO: 69466 - DNA, 15 bp, Artificial Sequence
  dgRNA
  Arhgef26
tggttggggaaatcg

SEQ ID NO: 69467 - DNA, 15 bp, Artificial Sequence
  dgRNA
  Arhgef26
ggttggggaaatcgg

SEQ ID NO: 69468 - DNA, 15 bp, Artificial Sequence
  dgRNA
  Gata5
caccccctgtttgtt

SEQ ID NO: 69469 - DNA, 15 bp, Artificial Sequence
  dgRNA
  Gata5
accccctgtttgttc

SEQ ID NO: 69470 - DNA, 15 bp, Artificial Sequence
  dgRNA
  Gata5
gttcgggctcagccg

SEQ ID NO: 69471 - DNA, 15 bp, Artificial Sequence
  dgRNA
  Gata5
ttcgggctcagccga

SEQ ID NO: 69472 - DNA, 15 bp, Artificial Sequence
  dgRNA
  Gltscr1
aggaaggttatcagc

SEQ ID NO: 69473 - DNA, 15 bp, Artificial Sequence
  dgRNA
  4933413G19Rik
acagcgaaaagcatc

SEQ ID NO: 69474 - DNA, 15 bp, Artificial Sequence
  dgRNA
  4933413G19Rik
cagcgaaaagcatca

SEQ ID NO: 69475 - DNA, 15 bp, Artificial Sequence
  dgRNA
  4933413G19Rik
gcgagagccttgcct

SEQ ID NO: 69476 - DNA, 15 bp, Artificial Sequence
  dgRNA
  4933413G19Rik
agcgagagccttgcc

SEQ ID NO: 69477 - DNA, 15 bp, Artificial Sequence
  dgRNA
  Olfr700
aacttatttactagt

SEQ ID NO: 69478 - DNA, 15 bp, Artificial Sequence
  dgRNA
  Olfr700
gatgttataatacta

SEQ ID NO: 69479 - DNA, 15 bp, Artificial Sequence
  dgRNA
  Olfr700
tactagggttcatat

SEQ ID NO: 69480 - DNA, 15 bp, Artificial Sequence
  dgRNA
  Batf2
gagaaggggcctaac

SEQ ID NO: 69481 - DNA, 15 bp, Artificial Sequence
  dgRNA
  Batf2
aggggcctaaccgga

SEQ ID NO: 69482 - DNA, 15 bp, Artificial Sequence
  dgRNA
  Batf2
gtgctaggggcggag

SEQ ID NO: 69483 - DNA, 15 bp, Artificial Sequence
  dgRNA
  Batf2
ggcggagtggccact

SEQ ID NO: 69484 - DNA, 15 bp, Artificial Sequence
  dgRNA
  Prmt1
ctcttcctagcggac

SEQ ID NO: 69485 - DNA, 15 bp, Artificial Sequence
  dgRNA
  Prmt1
ttcctagcggacagg

SEQ ID NO: 69486 - DNA, 15 bp, Artificial Sequence
  dgRNA
  Prmt1
cctagcggacaggag

SEQ ID NO: 69487 - DNA, 15 bp, Artificial Sequence
  dgRNA
  Prmt1
ctagcggacaggagg

SEQ ID NO: 69488 - DNA, 15 bp, Artificial Sequence
  dgRNA
  Ap5m1
caccgcctcgcacgc

SEQ ID NO: 69489 - DNA, 15 bp, Artificial Sequence
  dgRNA
  Ap5m1
ctcgcacgccggaag

SEQ ID NO: 69490 - DNA, 15 bp, Artificial Sequence
  dgRNA
  Ap5m1
tcgcacgccggaagt

SEQ ID NO: 69491 - DNA, 15 bp, Artificial Sequence
  dgRNA
  Ap5m1
cgcacgccggaagtg

SEQ ID NO: 69492 - DNA, 15 bp, Artificial Sequence
  dgRNA
  Ppdpf
gattcttgctccgct

SEQ ID NO: 69493 - DNA, 15 bp, Artificial Sequence
  dgRNA
  Ppdpf
attcttgctccgctc

SEQ ID NO: 69494 - DNA, 15 bp, Artificial Sequence
  dgRNA
  Ppdpf
ttcttgctccgctcg

SEQ ID NO: 69495 - DNA, 15 bp, Artificial Sequence
  dgRNA
  Ppdpf
ttgctccgctcgggg

SEQ ID NO: 69496 - DNA, 15 bp, Artificial Sequence
  dgRNA
  1700025F22Rik
gagtatgcccaacac

SEQ ID NO: 69497 - DNA, 15 bp, Artificial Sequence
  dgRNA
  1700025F22Rik
cgcatctacctctcg

SEQ ID NO: 69498 - DNA, 15 bp, Artificial Sequence
  dgRNA
  1700025F22Rik
gcatctacctctcgc

SEQ ID NO: 69499 - DNA, 15 bp, Artificial Sequence
  dgRNA
  1700025F22Rik
ctctcgcgggcatga

SEQ ID NO: 69500 - DNA, 15 bp, Artificial Sequence
  dgRNA
  1700011L22Rik
tatgtcaataccaat

SEQ ID NO: 69501 - DNA, 15 bp, Artificial Sequence
  dgRNA
  1700011L22Rik
gaaaatccgtgtcct

SEQ ID NO: 69502 - DNA, 15 bp, Artificial Sequence
  dgRNA
  1700011L22Rik
ttatgacctgttgct

SEQ ID NO: 69503 - DNA, 15 bp, Artificial Sequence
  dgRNA
  1700011L22Rik
atatggtatacctta

SEQ ID NO: 69504 - DNA, 15 bp, Artificial Sequence
  dgRNA
  Nfix
gccattggctgcaag

SEQ ID NO: 69505 - DNA, 15 bp, Artificial Sequence
  dgRNA
  Nfix
gcctctttgccaaat

SEQ ID NO: 69506 - DNA, 15 bp, Artificial Sequence
  dgRNA
  Nfix
tctttgccaaatagg

SEQ ID NO: 69507 - DNA, 15 bp, Artificial Sequence
  dgRNA
  Nfix
cgagctgagagggtg

SEQ ID NO: 69508 - DNA, 15 bp, Artificial Sequence
  dgRNA
  Nfrkb
gaaccccgcacagaa

SEQ ID NO: 69509 - DNA, 15 bp, Artificial Sequence
  dgRNA
  Nfrkb
caccgacgtagcttg

SEQ ID NO: 69510 - DNA, 15 bp, Artificial Sequence
  dgRNA
  Nfrkb
tggcaccagacgcgt

SEQ ID NO: 69511 - DNA, 15 bp, Artificial Sequence
  dgRNA
  Nfrkb
ggcaccagacgcgtc

SEQ ID NO: 69512 - DNA, 15 bp, Artificial Sequence
  dgRNA
  4933433C11Rik
aaggagggggtacta

SEQ ID NO: 69513 - DNA, 15 bp, Artificial Sequence
  dgRNA
  4933433C11Rik
gagcccctcctgatc

SEQ ID NO: 69514 - DNA, 15 bp, Artificial Sequence
  dgRNA
  4933433C11Rik
gaggggctctcccac

SEQ ID NO: 69515 - DNA, 15 bp, Artificial Sequence
  dgRNA
  4933433C11Rik
tgtccagatcaggag

SEQ ID NO: 69516 - DNA, 15 bp, Artificial Sequence
  dgRNA
  Cps1
ccattggaacatctc

SEQ ID NO: 69517 - DNA, 15 bp, Artificial Sequence
  dgRNA
  Gas6
cggtcaaattgtacc

SEQ ID NO: 69518 - DNA, 15 bp, Artificial Sequence
  dgRNA
  Gas6
ggtcaaattgtacct

SEQ ID NO: 69519 - DNA, 15 bp, Artificial Sequence
  dgRNA
  Gas6
cgccctactcacact

SEQ ID NO: 69520 - DNA, 15 bp, Artificial Sequence
  dgRNA
  Gas6
aaggagaattgtatc

SEQ ID NO: 69521 - DNA, 15 bp, Artificial Sequence
  dgRNA
  Rwdd4a
tttccccgcctccgc

SEQ ID NO: 69522 - DNA, 15 bp, Artificial Sequence
  dgRNA
  Rwdd4a
cgcctccgctggcac

SEQ ID NO: 69523 - DNA, 15 bp, Artificial Sequence
  dgRNA
  Rwdd4a
acgggtttccttgtt

SEQ ID NO: 69524 - DNA, 15 bp, Artificial Sequence
  dgRNA
  Rwdd4a
gacgcgatcgtgaga

SEQ ID NO: 69525 - DNA, 15 bp, Artificial Sequence
  dgRNA
  Nudt9
cgtgactcctccgta

SEQ ID NO: 69526 - DNA, 15 bp, Artificial Sequence
  dgRNA
  Nudt9
acggccctcctctcc

SEQ ID NO: 69527 - DNA, 15 bp, Artificial Sequence
  dgRNA
  Nudt9
tctcctggaagcacg

SEQ ID NO: 69528 - DNA, 15 bp, Artificial Sequence
  dgRNA
  Nudt9
ttccgctcagcctca

SEQ ID NO: 69529 - DNA, 15 bp, Artificial Sequence
  dgRNA
  Npnt
acttttctcgcagcc

SEQ ID NO: 69530 - DNA, 15 bp, Artificial Sequence
  dgRNA
  Npnt
cttttctcgcagccc

SEQ ID NO: 69531 - DNA, 15 bp, Artificial Sequence
  dgRNA
  Npnt
ttttctcgcagcccg

SEQ ID NO: 69532 - DNA, 15 bp, Artificial Sequence
  dgRNA
  Npnt
tttctcgcagcccgg

SEQ ID NO: 69533 - DNA, 15 bp, Artificial Sequence
  dgRNA
  Zfp148
cttggtctcgcagcc

SEQ ID NO: 69534 - DNA, 15 bp, Artificial Sequence
  dgRNA
  Zfp148
gcgccaagcgagggc

SEQ ID NO: 69535 - DNA, 15 bp, Artificial Sequence
  dgRNA
  Zfp148
ccaagcgagggccgg

SEQ ID NO: 69536 - DNA, 15 bp, Artificial Sequence
  dgRNA
  Zfp148
cgagggccggcggcc

SEQ ID NO: 69537 - DNA, 15 bp, Artificial Sequence
  dgRNA
  Prkab2
gccctaatcccgacc

SEQ ID NO: 69538 - DNA, 15 bp, Artificial Sequence
  dgRNA
  Prkab2
cccggaccccaccct

SEQ ID NO: 69539 - DNA, 15 bp, Artificial Sequence
  dgRNA
  Prkab2
ggccccgccccaagc

SEQ ID NO: 69540 - DNA, 15 bp, Artificial Sequence
  dgRNA
  Prkab2
aggcgacccaggctg

SEQ ID NO: 69541 - DNA, 15 bp, Artificial Sequence
  dgRNA
  Ppan
cttgccgaaacgttc

SEQ ID NO: 69542 - DNA, 15 bp, Artificial Sequence
  dgRNA
  Ppan
cgaaacgttcaggat

SEQ ID NO: 69543 - DNA, 15 bp, Artificial Sequence
  dgRNA
  Ppan
gaaacgttcaggata

SEQ ID NO: 69544 - DNA, 15 bp, Artificial Sequence
  dgRNA
  Ppan
cctcaaataattgtg

SEQ ID NO: 69545 - DNA, 15 bp, Artificial Sequence
  dgRNA
  Agbl5
acggtaaacaaagat

SEQ ID NO: 69546 - DNA, 15 bp, Artificial Sequence
  dgRNA
  Cep192
cccatctaaactgcg

SEQ ID NO: 69547 - DNA, 15 bp, Artificial Sequence
  dgRNA
  Cep192
taaactgcgcggctt

SEQ ID NO: 69548 - DNA, 15 bp, Artificial Sequence
  dgRNA
  Cep192
aaactgcgcggcttc

SEQ ID NO: 69549 - DNA, 15 bp, Artificial Sequence
  dgRNA
  Cep192
cgggccttcaaatcc

SEQ ID NO: 69550 - DNA, 15 bp, Artificial Sequence
  dgRNA
  Ttll8
agcagcacgcgcttt

SEQ ID NO: 69551 - DNA, 15 bp, Artificial Sequence
  dgRNA
  Ttll8
gcagcacgcgcttta

SEQ ID NO: 69552 - DNA, 15 bp, Artificial Sequence
  dgRNA
  Ttll8
gcacgcgctttaggg

SEQ ID NO: 69553 - DNA, 15 bp, Artificial Sequence
  dgRNA
  Ttll8
cacgcgctttagggc

SEQ ID NO: 69554 - DNA, 15 bp, Artificial Sequence
  dgRNA
  Opalin
gactgcggcgcatgc

SEQ ID NO: 69555 - DNA, 15 bp, Artificial Sequence
  dgRNA
  Opalin
actgcggcgcatgca

SEQ ID NO: 69556 - DNA, 15 bp, Artificial Sequence
  dgRNA
  Opalin
gcgcatgcagggagc

SEQ ID NO: 69557 - DNA, 15 bp, Artificial Sequence
  dgRNA
  Opalin
cgcatgcagggagca

SEQ ID NO: 69558 - DNA, 15 bp, Artificial Sequence
  dgRNA
  Reep1
gggacacgcggtgac

SEQ ID NO: 69559 - DNA, 15 bp, Artificial Sequence
  dgRNA
  Reep1
cgcggtgactggtga

SEQ ID NO: 69560 - DNA, 15 bp, Artificial Sequence
  dgRNA
  Reep1
gcggtgactggtgat

SEQ ID NO: 69561 - DNA, 15 bp, Artificial Sequence
  dgRNA
  Reep1
cggtgactggtgatg

SEQ ID NO: 69562 - DNA, 15 bp, Artificial Sequence
  dgRNA
  Fut2
ggctatcatcccagc

SEQ ID NO: 69563 - DNA, 15 bp, Artificial Sequence
  dgRNA
  Fut2
ttctaggatgtcagc

SEQ ID NO: 69564 - DNA, 15 bp, Artificial Sequence
  dgRNA
  Fut2
tcagcaggtacaccc

SEQ ID NO: 69565 - DNA, 15 bp, Artificial Sequence
  dgRNA
  Fut2
caggtacaccctggg

SEQ ID NO: 69566 - DNA, 15 bp, Artificial Sequence
  dgRNA
  Gm2012
ccctttgaagcaatg

SEQ ID NO: 69567 - DNA, 15 bp, Artificial Sequence
  dgRNA
  Ctf2
tatatgccctcatct

SEQ ID NO: 69568 - DNA, 15 bp, Artificial Sequence
  dgRNA
  Ctf2
tcctgggcggctcta

SEQ ID NO: 69569 - DNA, 15 bp, Artificial Sequence
  dgRNA
  Ctf2
gagggcatatattcc

SEQ ID NO: 69570 - DNA, 15 bp, Artificial Sequence
  dgRNA
  Ctf2
ggggagctagtccct

SEQ ID NO: 69571 - DNA, 15 bp, Artificial Sequence
  dgRNA
  Tigit
gtggctcaccctatg

SEQ ID NO: 69572 - DNA, 15 bp, Artificial Sequence
  dgRNA
  Tigit
gtatattgactactt

SEQ ID NO: 69573 - DNA, 15 bp, Artificial Sequence
  dgRNA
  Tigit
cgtatattgactact

SEQ ID NO: 69574 - DNA, 15 bp, Artificial Sequence
  dgRNA
  Tigit
agatacacgggtctt

SEQ ID NO: 69575 - DNA, 15 bp, Artificial Sequence
  dgRNA
  Olfr883
tcaggaatattattc

SEQ ID NO: 69576 - DNA, 15 bp, Artificial Sequence
  dgRNA
  Them6
tggcgctgtactgct

SEQ ID NO: 69577 - DNA, 15 bp, Artificial Sequence
  dgRNA
  Them6
aagccgctaacgcag

SEQ ID NO: 69578 - DNA, 15 bp, Artificial Sequence
  dgRNA
  Them6
cagactaggccatcg

SEQ ID NO: 69579 - DNA, 15 bp, Artificial Sequence
  dgRNA
  Them6
atcgaggacgcgcgc

SEQ ID NO: 69580 - DNA, 15 bp, Artificial Sequence
  dgRNA
  Spata7
ccttagcaaccgccc

SEQ ID NO: 69581 - DNA, 15 bp, Artificial Sequence
  dgRNA
  Spata7
taagggcgagctccg

SEQ ID NO: 69582 - DNA, 15 bp, Artificial Sequence
  dgRNA
  Spata7
cagggcggttgctaa

SEQ ID NO: 69583 - DNA, 15 bp, Artificial Sequence
  dgRNA
  Spata7
ccagggcggttgcta

SEQ ID NO: 69584 - DNA, 15 bp, Artificial Sequence
  dgRNA
  Rpp25
agcgctggatcccaa

SEQ ID NO: 69585 - DNA, 15 bp, Artificial Sequence
  dgRNA
  Rpp25
caagtcacgcagagt

SEQ ID NO: 69586 - DNA, 15 bp, Artificial Sequence
  dgRNA
  Rpp25
aagtcacgcagagtt

SEQ ID NO: 69587 - DNA, 15 bp, Artificial Sequence
  dgRNA
  Rpp25
agtcacgcagagttg

SEQ ID NO: 69588 - DNA, 15 bp, Artificial Sequence
  dgRNA
  Olfr461
tgtgccgcacctgac

SEQ ID NO: 69589 - DNA, 15 bp, Artificial Sequence
  dgRNA
  Olfr461
caataattagagatc

SEQ ID NO: 69590 - DNA, 15 bp, Artificial Sequence
  dgRNA
  Olfr461
gcggcacaacggcta

SEQ ID NO: 69591 - DNA, 15 bp, Artificial Sequence
  dgRNA
  Olfr461
tgcggcacaacggct

SEQ ID NO: 69592 - DNA, 15 bp, Artificial Sequence
  dgRNA
  Olfr1247
gttcaccattgcata

SEQ ID NO: 69593 - DNA, 15 bp, Artificial Sequence
  dgRNA
  Olfr1247
tttagaacttattgc

SEQ ID NO: 69594 - DNA, 15 bp, Artificial Sequence
  dgRNA
  Olfr1247
tattaccttatgcaa

SEQ ID NO: 69595 - DNA, 15 bp, Artificial Sequence
  dgRNA
  Olfr1247
ataatacttcagaac

SEQ ID NO: 69596 - DNA, 15 bp, Artificial Sequence
  dgRNA
  C1qtnf7
catcgtgataaatta

SEQ ID NO: 69597 - DNA, 15 bp, Artificial Sequence
  dgRNA
  C1qtnf7
ctgacacaattccac

SEQ ID NO: 69598 - DNA, 15 bp, Artificial Sequence
  dgRNA
  C1qtnf7
tagatactacttgaa

SEQ ID NO: 69599 - DNA, 15 bp, Artificial Sequence
  dgRNA
  C1qtnf7
atcacgatgtcttca

SEQ ID NO: 69600 - DNA, 15 bp, Artificial Sequence
  dgRNA
  Helz
cttgagaagtctcgc

SEQ ID NO: 69601 - DNA, 15 bp, Artificial Sequence
  dgRNA
  Helz
tctcgcaggcgctga

SEQ ID NO: 69602 - DNA, 15 bp, Artificial Sequence
  dgRNA
  Helz
ctcgcaggcgctgaa

SEQ ID NO: 69603 - DNA, 15 bp, Artificial Sequence
  dgRNA
  Helz
tcgcaggcgctgaag

SEQ ID NO: 69604 - DNA, 15 bp, Artificial Sequence
  dgRNA
  AU018091
ggaatctccagaact

SEQ ID NO: 69605 - DNA, 15 bp, Artificial Sequence
  dgRNA
  Plekho1
gcgctcacgtccgcc

SEQ ID NO: 69606 - DNA, 15 bp, Artificial Sequence
  dgRNA
  Plekho1
cgtccgcccggcagt

SEQ ID NO: 69607 - DNA, 15 bp, Artificial Sequence
  dgRNA
  Plekho1
gcagtaggtcgagag

SEQ ID NO: 69608 - DNA, 15 bp, Artificial Sequence
  dgRNA
  Plekho1
gagtggagactcccg

SEQ ID NO: 69609 - DNA, 15 bp, Artificial Sequence
  dgRNA
  Slc26a6
attctcagggtacct

SEQ ID NO: 69610 - DNA, 15 bp, Artificial Sequence
  dgRNA
  Slc26a6
gacccagtctcctgg

SEQ ID NO: 69611 - DNA, 15 bp, Artificial Sequence
  dgRNA
  Slc26a6
gtactgcatgtcatc

SEQ ID NO: 69612 - DNA, 15 bp, Artificial Sequence
  dgRNA
  Slc26a6
taccaccaggagact

SEQ ID NO: 69613 - DNA, 15 bp, Artificial Sequence
  dgRNA
  Ttll7
aggtccttagcgctc

SEQ ID NO: 69614 - DNA, 15 bp, Artificial Sequence
  dgRNA
  Ttll7
gctcaggcctagttg

SEQ ID NO: 69615 - DNA, 15 bp, Artificial Sequence
  dgRNA
  Ttll7
ctcaggcctagttgt

SEQ ID NO: 69616 - DNA, 15 bp, Artificial Sequence
  dgRNA
  Ttll7
cctagttgtgggtag

SEQ ID NO: 69617 - DNA, 15 bp, Artificial Sequence
  dgRNA
  E130309D14Rik
ccagggccggatccg

SEQ ID NO: 69618 - DNA, 15 bp, Artificial Sequence
  dgRNA
  E130309D14Rik
ggattctgctgctcg

SEQ ID NO: 69619 - DNA, 15 bp, Artificial Sequence
  dgRNA
  E130309D14Rik
gattctgctgctcgc

SEQ ID NO: 69620 - DNA, 15 bp, Artificial Sequence
  dgRNA
  E130309D14Rik
attctgctgctcgcg

SEQ ID NO: 69621 - DNA, 15 bp, Artificial Sequence
  dgRNA
  Olfr888
atgggagtattattc

SEQ ID NO: 69622 - DNA, 15 bp, Artificial Sequence
  dgRNA
  Olfr888
catgcttgttggcac

SEQ ID NO: 69623 - DNA, 15 bp, Artificial Sequence
  dgRNA
  Olfr888
ttatcccatgcttgt

SEQ ID NO: 69624 - DNA, 15 bp, Artificial Sequence
  dgRNA
  Dap3
tccctcacccgactc

SEQ ID NO: 69625 - DNA, 15 bp, Artificial Sequence
  dgRNA
  Dap3
ccgcacgcttccgag

SEQ ID NO: 69626 - DNA, 15 bp, Artificial Sequence
  dgRNA
  Dap3
cgcacgcttccgagt

SEQ ID NO: 69627 - DNA, 15 bp, Artificial Sequence
  dgRNA
  Dap3
gcttccgagtgggtc

SEQ ID NO: 69628 - DNA, 15 bp, Artificial Sequence
  dgRNA
  Mpp1
gctgcgcatctcgac

SEQ ID NO: 69629 - DNA, 15 bp, Artificial Sequence
  dgRNA
  Mpp1
ctgcgcatctcgaca

SEQ ID NO: 69630 - DNA, 15 bp, Artificial Sequence
  dgRNA
  Mpp1
cgacagggcccgcag

SEQ ID NO: 69631 - DNA, 15 bp, Artificial Sequence
  dgRNA
  Mpp1
gggcccgcagaggcg

SEQ ID NO: 69632 - DNA, 15 bp, Artificial Sequence
  dgRNA
  Chdh
actacacaaccgtta

SEQ ID NO: 69633 - DNA, 15 bp, Artificial Sequence
  dgRNA
  Chdh
tactacacaaccgtt

SEQ ID NO: 69634 - DNA, 15 bp, Artificial Sequence
  dgRNA
  Fgd3
gccaggtcgagtaaa

SEQ ID NO: 69635 - DNA, 15 bp, Artificial Sequence
  dgRNA
  Fgd3
gttgcgtcatcgcta

SEQ ID NO: 69636 - DNA, 15 bp, Artificial Sequence
  dgRNA
  Fgd3
tccttttactcgacc

SEQ ID NO: 69637 - DNA, 15 bp, Artificial Sequence
  dgRNA
  Fgd3
acgcaacgtgagagg

SEQ ID NO: 69638 - DNA, 15 bp, Artificial Sequence
  dgRNA
  Cep104
gtaccgtagcgacac

SEQ ID NO: 69639 - DNA, 15 bp, Artificial Sequence
  dgRNA
  Cep104
tgtaacgttcctgcc

SEQ ID NO: 69640 - DNA, 15 bp, Artificial Sequence
  dgRNA
  Cep104
tcctgcccggaactg

SEQ ID NO: 69641 - DNA, 15 bp, Artificial Sequence
  dgRNA
  Cep104
tgtggtgcgtagacg

SEQ ID NO: 69642 - DNA, 15 bp, Artificial Sequence
  dgRNA
  Olfr1240
aatgttataccatga

SEQ ID NO: 69643 - DNA, 15 bp, Artificial Sequence
  dgRNA
  Olfr1240
gttataccatgaagg

SEQ ID NO: 69644 - DNA, 15 bp, Artificial Sequence
  dgRNA
  Olfr1240
atgtttacaatttcg

SEQ ID NO: 69645 - DNA, 15 bp, Artificial Sequence
  dgRNA
  Olfr1240
tcactcctgattaat

SEQ ID NO: 69646 - DNA, 15 bp, Artificial Sequence
  dgRNA
  Msmo1
tttttccccgggttc

SEQ ID NO: 69647 - DNA, 15 bp, Artificial Sequence
  dgRNA
  Msmo1
gcgcacccacagcac

SEQ ID NO: 69648 - DNA, 15 bp, Artificial Sequence
  dgRNA
  Msmo1
taggaacccaccgct

SEQ ID NO: 69649 - DNA, 15 bp, Artificial Sequence
  dgRNA
  Msmo1
ttgccaaggcgacgc

SEQ ID NO: 69650 - DNA, 15 bp, Artificial Sequence
  dgRNA
  Neil3
gtttttacactgagc

SEQ ID NO: 69651 - DNA, 15 bp, Artificial Sequence
  dgRNA
  Neil3
cgcaccacctaggcg

SEQ ID NO: 69652 - DNA, 15 bp, Artificial Sequence
  dgRNA
  Neil3
cacctaggcgtggcc

SEQ ID NO: 69653 - DNA, 15 bp, Artificial Sequence
  dgRNA
  Neil3
tggcctggccgcaga

SEQ ID NO: 69654 - DNA, 15 bp, Artificial Sequence
  dgRNA
  Olfr974
aatcttgatgatagc

SEQ ID NO: 69655 - DNA, 15 bp, Artificial Sequence
  dgRNA
  Olfr974
agattacattccatt

SEQ ID NO: 69656 - DNA, 15 bp, Artificial Sequence
  dgRNA
  Hpdl
tccgtctgttgagaa

SEQ ID NO: 69657 - DNA, 15 bp, Artificial Sequence
  dgRNA
  Hpdl
acacgggcagtcctt

SEQ ID NO: 69658 - DNA, 15 bp, Artificial Sequence
  dgRNA
  Hpdl
taggctctaaggtcg

SEQ ID NO: 69659 - DNA, 15 bp, Artificial Sequence
  dgRNA
  Hpdl
aggctctaaggtcgc

SEQ ID NO: 69660 - DNA, 15 bp, Artificial Sequence
  dgRNA
  Pidd1
acagatgcaagccgt

SEQ ID NO: 69661 - DNA, 15 bp, Artificial Sequence
  dgRNA
  Pidd1
cagatgcaagccgta

SEQ ID NO: 69662 - DNA, 15 bp, Artificial Sequence
  dgRNA
  Pidd1
ctaccccttgtgccc

SEQ ID NO: 69663 - DNA, 15 bp, Artificial Sequence
  dgRNA
  Pidd1
attgttgctctgacc

SEQ ID NO: 69664 - DNA, 15 bp, Artificial Sequence
  dgRNA
  Xpnpep3
gaacgagacgccgca

SEQ ID NO: 69665 - DNA, 15 bp, Artificial Sequence
  dgRNA
  Xpnpep3
cgagacgccgcatgg

SEQ ID NO: 69666 - DNA, 15 bp, Artificial Sequence
  dgRNA
  Xpnpep3
gacgccgcatggagg

SEQ ID NO: 69667 - DNA, 15 bp, Artificial Sequence
  dgRNA
  Xpnpep3
acgccgcatggagga

SEQ ID NO: 69668 - DNA, 15 bp, Artificial Sequence
  dgRNA
  Olfr1272
aagagcccgagcttt

SEQ ID NO: 69669 - DNA, 15 bp, Artificial Sequence
  dgRNA
  Olfr1272
agagcccgagctttt

SEQ ID NO: 69670 - DNA, 15 bp, Artificial Sequence
  dgRNA
  Olfr1272
tagacatcagataat

SEQ ID NO: 69671 - DNA, 15 bp, Artificial Sequence
  dgRNA
  Slc4a5
ctcaagatcttaacg

SEQ ID NO: 69672 - DNA, 15 bp, Artificial Sequence
  dgRNA
  Slc4a5
tcttaacgaggccct

SEQ ID NO: 69673 - DNA, 15 bp, Artificial Sequence
  dgRNA
  Slc4a5
cttaacgaggcccta

SEQ ID NO: 69674 - DNA, 15 bp, Artificial Sequence
  dgRNA
  Slc4a5
ttaacgaggccctag

SEQ ID NO: 69675 - DNA, 15 bp, Artificial Sequence
  dgRNA
  Hoxb4
gcccctatgacctag

SEQ ID NO: 69676 - DNA, 15 bp, Artificial Sequence
  dgRNA
  Hoxb4
cccctatgacctagt

SEQ ID NO: 69677 - DNA, 15 bp, Artificial Sequence
  dgRNA
  Hoxb4
caagaaggcgctccc

SEQ ID NO: 69678 - DNA, 15 bp, Artificial Sequence
  dgRNA
  Hoxb4
aaggcgctccctggt

SEQ ID NO: 69679 - DNA, 15 bp, Artificial Sequence
  dgRNA
  Olfr1350
cgtaggtccttgcta

SEQ ID NO: 69680 - DNA, 15 bp, Artificial Sequence
  dgRNA
  Olfr1350
aggacctacgaggaa

SEQ ID NO: 69681 - DNA, 15 bp, Artificial Sequence
  dgRNA
  Olfr1350
tagcaaggacctacg

SEQ ID NO: 69682 - DNA, 15 bp, Artificial Sequence
  dgRNA
  Olfr1350
ctcggaacaaggagc

SEQ ID NO: 69683 - DNA, 15 bp, Artificial Sequence
  dgRNA
  Arap1
tagtttgcacggtgc

SEQ ID NO: 69684 - DNA, 15 bp, Artificial Sequence
  dgRNA
  Arap1
tgctggcgtggcctg

SEQ ID NO: 69685 - DNA, 15 bp, Artificial Sequence
  dgRNA
  Arap1
ctggcgtggcctgag

SEQ ID NO: 69686 - DNA, 15 bp, Artificial Sequence
  dgRNA
  Arap1
gaagtatctgtccca

SEQ ID NO: 69687 - DNA, 15 bp, Artificial Sequence
  dgRNA
  4930402H24Rik
gaccttagggcccgg

SEQ ID NO: 69688 - DNA, 15 bp, Artificial Sequence
  dgRNA
  4930402H24Rik
tagggcccggaggtg

SEQ ID NO: 69689 - DNA, 15 bp, Artificial Sequence
  dgRNA
  4930402H24Rik
cccggagcctgcgcc

SEQ ID NO: 69690 - DNA, 15 bp, Artificial Sequence
  dgRNA
  4930402H24Rik
caccccaagtccgtc

SEQ ID NO: 69691 - DNA, 15 bp, Artificial Sequence
  dgRNA
  Vmn1r178
atcaattgataagcg

SEQ ID NO: 69692 - DNA, 15 bp, Artificial Sequence
  dgRNA
  Vmn1r178
cagtcgtgaggacat

SEQ ID NO: 69693 - DNA, 15 bp, Artificial Sequence
  dgRNA
  Vmn1r178
tataatcatcactcc

SEQ ID NO: 69694 - DNA, 15 bp, Artificial Sequence
  dgRNA
  Vmn1r178
tcatcactccagggt

SEQ ID NO: 69695 - DNA, 15 bp, Artificial Sequence
  dgRNA
  Stard7
aaatggctgcaccgc

SEQ ID NO: 69696 - DNA, 15 bp, Artificial Sequence
  dgRNA
  Stard7
gcaccgccgggtccg

SEQ ID NO: 69697 - DNA, 15 bp, Artificial Sequence
  dgRNA
  Stard7
caccgccgggtccga

SEQ ID NO: 69698 - DNA, 15 bp, Artificial Sequence
  dgRNA
  Stard7
cgagggtcactctcc

SEQ ID NO: 69699 - DNA, 15 bp, Artificial Sequence
  dgRNA
  Tbx22
accttgagtcaaagc

SEQ ID NO: 69700 - DNA, 15 bp, Artificial Sequence
  dgRNA
  Tbx22
cttgggggtgctgca

SEQ ID NO: 69701 - DNA, 15 bp, Artificial Sequence
  dgRNA
  Tbx22
taggactgacactgc

SEQ ID NO: 69702 - DNA, 15 bp, Artificial Sequence
  dgRNA
  Tbx22
gtttttgccagcagt

SEQ ID NO: 69703 - DNA, 15 bp, Artificial Sequence
  dgRNA
  Abca17
agctcaacactagtt

SEQ ID NO: 69704 - DNA, 15 bp, Artificial Sequence
  dgRNA
  Nin
gtgtacaagtaccac

SEQ ID NO: 69705 - DNA, 15 bp, Artificial Sequence
  dgRNA
  Nin
caagtaccactggcc

SEQ ID NO: 69706 - DNA, 15 bp, Artificial Sequence
  dgRNA
  Nin
acaggtgagcgctgt

SEQ ID NO: 69707 - DNA, 15 bp, Artificial Sequence
  dgRNA
  Nin
gggacaggtcacaat

SEQ ID NO: 69708 - DNA, 15 bp, Artificial Sequence
  dgRNA
  Armc2
gcccgcgctcccgca

SEQ ID NO: 69709 - DNA, 15 bp, Artificial Sequence
  dgRNA
  Armc2
cccgcgctcccgcac

SEQ ID NO: 69710 - DNA, 15 bp, Artificial Sequence
  dgRNA
  Armc2
gctgctacgcgtgcg

SEQ ID NO: 69711 - DNA, 15 bp, Artificial Sequence
  dgRNA
  Armc2
cgcgtgcgtggctag

SEQ ID NO: 69712 - DNA, 15 bp, Artificial Sequence
  dgRNA
  Ap3m2
cttcatcctccaatc

SEQ ID NO: 69713 - DNA, 15 bp, Artificial Sequence
  dgRNA
  Ap3m2
ttcatcctccaatcg

SEQ ID NO: 69714 - DNA, 15 bp, Artificial Sequence
  dgRNA
  Ap3m2
cctccaatcggggct

SEQ ID NO: 69715 - DNA, 15 bp, Artificial Sequence
  dgRNA
  Ap3m2
ccaattgaaggttac

SEQ ID NO: 69716 - DNA, 15 bp, Artificial Sequence
  dgRNA
  Kit
ggcgtggccacgagc

SEQ ID NO: 69717 - DNA, 15 bp, Artificial Sequence
  dgRNA
  Kit
gcgtggccacgagct

SEQ ID NO: 69718 - DNA, 15 bp, Artificial Sequence
  dgRNA
  Trmu
cgaccaactcatcgc

SEQ ID NO: 69719 - DNA, 15 bp, Artificial Sequence
  dgRNA
  Trmu
catcgctggcctatc

SEQ ID NO: 69720 - DNA, 15 bp, Artificial Sequence
  dgRNA
  Trmu
atcgctggcctatct

SEQ ID NO: 69721 - DNA, 15 bp, Artificial Sequence
  dgRNA
  Trmu
ggccgatccgccgcg

SEQ ID NO: 69722 - DNA, 15 bp, Artificial Sequence
  dgRNA
  Prl3c1
gttaatattccctga

SEQ ID NO: 69723 - DNA, 15 bp, Artificial Sequence
  dgRNA
  Prl3c1
tacaaccctaactga

SEQ ID NO: 69724 - DNA, 15 bp, Artificial Sequence
  dgRNA
  Prl3c1
agtactactactatg

SEQ ID NO: 69725 - DNA, 15 bp, Artificial Sequence
  dgRNA
  Slc24a2
agcactttcgggctt

SEQ ID NO: 69726 - DNA, 15 bp, Artificial Sequence
  dgRNA
  Slc24a2
gcactttcgggcttc

SEQ ID NO: 69727 - DNA, 15 bp, Artificial Sequence
  dgRNA
  Slc24a2
cgggcttcgggaagc

SEQ ID NO: 69728 - DNA, 15 bp, Artificial Sequence
  dgRNA
  Slc24a2
acccggtccccactg

SEQ ID NO: 69729 - DNA, 15 bp, Artificial Sequence
  dgRNA
  Tie1
ccaaaccttctcaat

SEQ ID NO: 69730 - DNA, 15 bp, Artificial Sequence
  dgRNA
  Tie1
aaccttctcaatagg

SEQ ID NO: 69731 - DNA, 15 bp, Artificial Sequence
  dgRNA
  Tie1
ataggcggaagccac

SEQ ID NO: 69732 - DNA, 15 bp, Artificial Sequence
  dgRNA
  Tie1
ggcaggacattgttc

SEQ ID NO: 69733 - DNA, 15 bp, Artificial Sequence
  dgRNA
  Btnl6
cagtgttgggtagta

SEQ ID NO: 69734 - DNA, 15 bp, Artificial Sequence
  dgRNA
  Btnl6
aatccacccagatct

SEQ ID NO: 69735 - DNA, 15 bp, Artificial Sequence
  dgRNA
  Btnl6
atcaataacctgggg

SEQ ID NO: 69736 - DNA, 15 bp, Artificial Sequence
  dgRNA
  Btnl6
cagatcaataacctg

SEQ ID NO: 69737 - DNA, 15 bp, Artificial Sequence
  dgRNA
  Zfp41
gcaccaccgagaggc

SEQ ID NO: 69738 - DNA, 15 bp, Artificial Sequence
  dgRNA
  Zfp41
caccaccgagaggcc

SEQ ID NO: 69739 - DNA, 15 bp, Artificial Sequence
  dgRNA
  Zfp41
accaccgagaggccg

SEQ ID NO: 69740 - DNA, 15 bp, Artificial Sequence
  dgRNA
  Zfp41
tccccggcctctcgg

SEQ ID NO: 69741 - DNA, 15 bp, Artificial Sequence
  dgRNA
  Zfp949
ggttctatactactt

SEQ ID NO: 69742 - DNA, 15 bp, Artificial Sequence
  dgRNA
  Zfp949
gttctatactacttt

SEQ ID NO: 69743 - DNA, 15 bp, Artificial Sequence
  dgRNA
  Zfp949
tcgcgattatcagat

SEQ ID NO: 69744 - DNA, 15 bp, Artificial Sequence
  dgRNA
  Cds1
attgacgtcatcgcc

SEQ ID NO: 69745 - DNA, 15 bp, Artificial Sequence
  dgRNA
  Cds1
ttgacgtcatcgccc

SEQ ID NO: 69746 - DNA, 15 bp, Artificial Sequence
  dgRNA
  Cds1
tgacgtcatcgcccg

SEQ ID NO: 69747 - DNA, 15 bp, Artificial Sequence
  dgRNA
  Cds1
cgtcatcgcccgggg

SEQ ID NO: 69748 - DNA, 15 bp, Artificial Sequence
  dgRNA
  Dmrt3
aggtgcaggaacccg

SEQ ID NO: 69749 - DNA, 15 bp, Artificial Sequence
  dgRNA
  Dmrt3
ggtgcaggaacccga

SEQ ID NO: 69750 - DNA, 15 bp, Artificial Sequence
  dgRNA
  Dmrt3
gtgcaggaacccgag

SEQ ID NO: 69751 - DNA, 15 bp, Artificial Sequence
  dgRNA
  Dmrt3
cgaggggtgcctgcc

SEQ ID NO: 69752 - DNA, 15 bp, Artificial Sequence
  dgRNA
  Pcm1
cggtacgtgactcca

SEQ ID NO: 69753 - DNA, 15 bp, Artificial Sequence
  dgRNA
  Pcm1
acgtgactccacgga

SEQ ID NO: 69754 - DNA, 15 bp, Artificial Sequence
  dgRNA
  Pcm1
agcgtcacgtgactc

SEQ ID NO: 69755 - DNA, 15 bp, Artificial Sequence
  dgRNA
  Pcm1
aggtcaccgcacgcc

SEQ ID NO: 69756 - DNA, 15 bp, Artificial Sequence
  dgRNA
  Tbccd1
agccgtcgtgtccgc

SEQ ID NO: 69757 - DNA, 15 bp, Artificial Sequence
  dgRNA
  Tbccd1
gtgtccgccggccaa

SEQ ID NO: 69758 - DNA, 15 bp, Artificial Sequence
  dgRNA
  Tbccd1
tgtccgccggccaat

SEQ ID NO: 69759 - DNA, 15 bp, Artificial Sequence
  dgRNA
  Tbccd1
gaggttcgcgccgcc

SEQ ID NO: 69760 - DNA, 15 bp, Artificial Sequence
  dgRNA
  Gsg1
aaatgtcctcgttca

SEQ ID NO: 69761 - DNA, 15 bp, Artificial Sequence
  dgRNA
  Gsg1
cagcatttaatcaag

SEQ ID NO: 69762 - DNA, 15 bp, Artificial Sequence
  dgRNA
  Gsg1
cttgttccctagtaa

SEQ ID NO: 69763 - DNA, 15 bp, Artificial Sequence
  dgRNA
  Gsg1
tcttgttccctagta

SEQ ID NO: 69764 - DNA, 15 bp, Artificial Sequence
  dgRNA
  Pkdcc
aggcccggctggccg

SEQ ID NO: 69765 - DNA, 15 bp, Artificial Sequence
  dgRNA
  Pkdcc
ccggctggccgcggg

SEQ ID NO: 69766 - DNA, 15 bp, Artificial Sequence
  dgRNA
  Pkdcc
cccgctgtcagtcag

SEQ ID NO: 69767 - DNA, 15 bp, Artificial Sequence
  dgRNA
  Pkdcc
ccgctgtcagtcagc

SEQ ID NO: 69768 - DNA, 15 bp, Artificial Sequence
  dgRNA
  Eif3f
tactaggaactactc

SEQ ID NO: 69769 - DNA, 15 bp, Artificial Sequence
  dgRNA
  Eif3f
acactgagtgcgcat

SEQ ID NO: 69770 - DNA, 15 bp, Artificial Sequence
  dgRNA
  Eif3f
aaacttacaactagc

SEQ ID NO: 69771 - DNA, 15 bp, Artificial Sequence
  dgRNA
  Eif3f
aagatatgattcacg

SEQ ID NO: 69772 - DNA, 15 bp, Artificial Sequence
  dgRNA
  Ptx3
cagcaactaatcctc

SEQ ID NO: 69773 - DNA, 15 bp, Artificial Sequence
  dgRNA
  Ptx3
agcaactaatcctca

SEQ ID NO: 69774 - DNA, 15 bp, Artificial Sequence
  dgRNA
  Ptx3
gcaactaatcctcag

SEQ ID NO: 69775 - DNA, 15 bp, Artificial Sequence
  dgRNA
  Ptx3
tgctagcgctttggg

SEQ ID NO: 69776 - DNA, 15 bp, Artificial Sequence
  dgRNA
  Proc
gaggtctaaagtcac

SEQ ID NO: 69777 - DNA, 15 bp, Artificial Sequence
  dgRNA
  Proc
gtagggctctccacc

SEQ ID NO: 69778 - DNA, 15 bp, Artificial Sequence
  dgRNA
  Proc
atgaacacatcggca

SEQ ID NO: 69779 - DNA, 15 bp, Artificial Sequence
  dgRNA
  Proc
gcttcattcgggatt

SEQ ID NO: 69780 - DNA, 15 bp, Artificial Sequence
  dgRNA
  Amer3
attatgggagcagct

SEQ ID NO: 69781 - DNA, 15 bp, Artificial Sequence
  dgRNA
  Amer3
gcggcggcgcagtgg

SEQ ID NO: 69782 - DNA, 15 bp, Artificial Sequence
  dgRNA
  Amer3
ctcgccagcgtcctc

SEQ ID NO: 69783 - DNA, 15 bp, Artificial Sequence
  dgRNA
  Amer3
ccgccctcccaagcg

SEQ ID NO: 69784 - DNA, 15 bp, Artificial Sequence
  dgRNA
  Ptpra
tgggagacgtgtgcc

SEQ ID NO: 69785 - DNA, 15 bp, Artificial Sequence
  dgRNA
  Ptpra
gggagacgtgtgcca

SEQ ID NO: 69786 - DNA, 15 bp, Artificial Sequence
  dgRNA
  Ptpra
ggagacgtgtgccag

SEQ ID NO: 69787 - DNA, 15 bp, Artificial Sequence
  dgRNA
  Ptpra
tgccaggggaggata

SEQ ID NO: 69788 - DNA, 15 bp, Artificial Sequence
  dgRNA
  Slc18a3
aagcggacccctgcc

SEQ ID NO: 69789 - DNA, 15 bp, Artificial Sequence
  dgRNA
  Slc18a3
gacgcgccccgcccc

SEQ ID NO: 69790 - DNA, 15 bp, Artificial Sequence
  dgRNA
  Slc18a3
catgagcgacgccag

SEQ ID NO: 69791 - DNA, 15 bp, Artificial Sequence
  dgRNA
  Slc18a3
gcgacgccagtggcc

SEQ ID NO: 69792 - DNA, 15 bp, Artificial Sequence
  dgRNA
  Tsks
ggaccctgagcgccg

SEQ ID NO: 69793 - DNA, 15 bp, Artificial Sequence
  dgRNA
  Tsks
gaccctgagcgccgg

SEQ ID NO: 69794 - DNA, 15 bp, Artificial Sequence
  dgRNA
  Tsks
accctgagcgccggg

SEQ ID NO: 69795 - DNA, 15 bp, Artificial Sequence
  dgRNA
  Tsks
ccctgagcgccgggg

SEQ ID NO: 69796 - DNA, 15 bp, Artificial Sequence
  dgRNA
  Krtap7-1
tgcaaatttgaggga

SEQ ID NO: 69797 - DNA, 15 bp, Artificial Sequence
  dgRNA
  Krtap7-1
tataccttgagctgg

SEQ ID NO: 69798 - DNA, 15 bp, Artificial Sequence
  dgRNA
  Krtap7-1
ttttataccttgagc

SEQ ID NO: 69799 - DNA, 15 bp, Artificial Sequence
  dgRNA
  Eras
accctactgcagttc

SEQ ID NO: 69800 - DNA, 15 bp, Artificial Sequence
  dgRNA
  Eras
ctgcagttcaggcga

SEQ ID NO: 69801 - DNA, 15 bp, Artificial Sequence
  dgRNA
  Eras
cagttcaggcgaagg

SEQ ID NO: 69802 - DNA, 15 bp, Artificial Sequence
  dgRNA
  Eras
agttcaggcgaagga

SEQ ID NO: 69803 - DNA, 15 bp, Artificial Sequence
  dgRNA
  Tspyl3
ctagcaagtcacatc

SEQ ID NO: 69804 - DNA, 15 bp, Artificial Sequence
  dgRNA
  Tspyl3
gggctggtatagact

SEQ ID NO: 69805 - DNA, 15 bp, Artificial Sequence
  dgRNA
  Tspyl3
gagtcactccactgc

SEQ ID NO: 69806 - DNA, 15 bp, Artificial Sequence
  dgRNA
  Kazn
gagcgggataagaag

SEQ ID NO: 69807 - DNA, 15 bp, Artificial Sequence
  dgRNA
  Kazn
ctggggccagacgca

SEQ ID NO: 69808 - DNA, 15 bp, Artificial Sequence
  dgRNA
  Kazn
tggggccagacgcat

SEQ ID NO: 69809 - DNA, 15 bp, Artificial Sequence
  dgRNA
  Kazn
ggggccagacgcatg

SEQ ID NO: 69810 - DNA, 15 bp, Artificial Sequence
  dgRNA
  Kirrel
tctcgcaccaagcac

SEQ ID NO: 69811 - DNA, 15 bp, Artificial Sequence
  dgRNA
  Kirrel
cgcaccaagcactgg

SEQ ID NO: 69812 - DNA, 15 bp, Artificial Sequence
  dgRNA
  Kirrel
gcaccaagcactggt

SEQ ID NO: 69813 - DNA, 15 bp, Artificial Sequence
  dgRNA
  Kirrel
ctcggttccagcgag

SEQ ID NO: 69814 - DNA, 15 bp, Artificial Sequence
  dgRNA
  Wasf2
tgtttactccgattg

SEQ ID NO: 69815 - DNA, 15 bp, Artificial Sequence
  dgRNA
  Wasf2
attgcggaagtcgct

SEQ ID NO: 69816 - DNA, 15 bp, Artificial Sequence
  dgRNA
  Wasf2
ttgcggaagtcgctc

SEQ ID NO: 69817 - DNA, 15 bp, Artificial Sequence
  dgRNA
  Wasf2
cggaagtcgctcggg

SEQ ID NO: 69818 - DNA, 15 bp, Artificial Sequence
  dgRNA
  Ppp2ca
agaggtatcacccag

SEQ ID NO: 69819 - DNA, 15 bp, Artificial Sequence
  dgRNA
  Ppp2ca
aaaacctcgcctaca

SEQ ID NO: 69820 - DNA, 15 bp, Artificial Sequence
  dgRNA
  Ppp2ca
gcgccgagaccgcgc

SEQ ID NO: 69821 - DNA, 15 bp, Artificial Sequence
  dgRNA
  Ppp2ca
cgcgcaggcgccctg

SEQ ID NO: 69822 - DNA, 15 bp, Artificial Sequence
  dgRNA
  Pth1r
ctgctgaaagacccg

SEQ ID NO: 69823 - DNA, 15 bp, Artificial Sequence
  dgRNA
  Pth1r
tgaaagacccggggc

SEQ ID NO: 69824 - DNA, 15 bp, Artificial Sequence
  dgRNA
  Pth1r
gaaagacccggggca

SEQ ID NO: 69825 - DNA, 15 bp, Artificial Sequence
  dgRNA
  Pth1r
ccggggcagggtctc

SEQ ID NO: 69826 - DNA, 15 bp, Artificial Sequence
  dgRNA
  Il11
gccggctcgtctgaa

SEQ ID NO: 69827 - DNA, 15 bp, Artificial Sequence
  dgRNA
  Il11
tcgtctgaatggaaa

SEQ ID NO: 69828 - DNA, 15 bp, Artificial Sequence
  dgRNA
  Il11
cctatataacccccc

SEQ ID NO: 69829 - DNA, 15 bp, Artificial Sequence
  dgRNA
  Il11
cgccttgcttggagg

SEQ ID NO: 69830 - DNA, 15 bp, Artificial Sequence
  dgRNA
  Cox7a1
tcccagattatcagc

SEQ ID NO: 69831 - DNA, 15 bp, Artificial Sequence
  dgRNA
  Cox7a1
cccagattatcagca

SEQ ID NO: 69832 - DNA, 15 bp, Artificial Sequence
  dgRNA
  Cox7a1
ccctagataacagcc

SEQ ID NO: 69833 - DNA, 15 bp, Artificial Sequence
  dgRNA
  Cox7a1
cctagataacagcca

SEQ ID NO: 69834 - DNA, 15 bp, Artificial Sequence
  dgRNA
  Tbx22
ggttgatttgtattc

SEQ ID NO: 69835 - DNA, 15 bp, Artificial Sequence
  dgRNA
  Tbx22
agttcgaaaaaaatc

SEQ ID NO: 69836 - DNA, 15 bp, Artificial Sequence
  dgRNA
  Cct3
cttgcgcagacattc

SEQ ID NO: 69837 - DNA, 15 bp, Artificial Sequence
  dgRNA
  Cct3
cattctggccgcacg

SEQ ID NO: 69838 - DNA, 15 bp, Artificial Sequence
  dgRNA
  Cct3
ctggccgcacgcggc

SEQ ID NO: 69839 - DNA, 15 bp, Artificial Sequence
  dgRNA
  Cct3
tggccgcacgcggcc

SEQ ID NO: 69840 - DNA, 15 bp, Artificial Sequence
  dgRNA
  Chsy1
tggccgcagactgcg

SEQ ID NO: 69841 - DNA, 15 bp, Artificial Sequence
  dgRNA
  Chsy1
ccgcagactgcgggg

SEQ ID NO: 69842 - DNA, 15 bp, Artificial Sequence
  dgRNA
  Chsy1
cgcagactgcggggc

SEQ ID NO: 69843 - DNA, 15 bp, Artificial Sequence
  dgRNA
  Chsy1
tttgcgccaatcacg

SEQ ID NO: 69844 - DNA, 15 bp, Artificial Sequence
  dgRNA
  Hpcal4
gatcccctccaggta

SEQ ID NO: 69845 - DNA, 15 bp, Artificial Sequence
  dgRNA
  Hpcal4
atcccctccaggtac

SEQ ID NO: 69846 - DNA, 15 bp, Artificial Sequence
  dgRNA
  Hpcal4
cctccaggtacgggc

SEQ ID NO: 69847 - DNA, 15 bp, Artificial Sequence
  dgRNA
  Hpcal4
gcaggacaagagacg

SEQ ID NO: 69848 - DNA, 15 bp, Artificial Sequence
  dgRNA
  Ppp4c
gcggctcgcctcacc

SEQ ID NO: 69849 - DNA, 15 bp, Artificial Sequence
  dgRNA
  Ppp4c
atacacaagtacacc

SEQ ID NO: 69850 - DNA, 15 bp, Artificial Sequence
  dgRNA
  Ppp4c
cccggtgcctcagcg

SEQ ID NO: 69851 - DNA, 15 bp, Artificial Sequence
  dgRNA
  Ppp4c
tgcctcagcgaggcg

SEQ ID NO: 69852 - DNA, 15 bp, Artificial Sequence
  dgRNA
  Cyp21a1
tgcactccactcagc

SEQ ID NO: 69853 - DNA, 15 bp, Artificial Sequence
  dgRNA
  5530400C23Rik
atttgagtgtcagtt

SEQ ID NO: 69854 - DNA, 15 bp, Artificial Sequence
  dgRNA
  Aip
tgctaaactgggggc

SEQ ID NO: 69855 - DNA, 15 bp, Artificial Sequence
  dgRNA
  Aip
gctaaactgggggcc

SEQ ID NO: 69856 - DNA, 15 bp, Artificial Sequence
  dgRNA
  Hilpda
gaaggaactcctgcg

SEQ ID NO: 69857 - DNA, 15 bp, Artificial Sequence
  dgRNA
  Hilpda
gtgggaaggccccgc

SEQ ID NO: 69858 - DNA, 15 bp, Artificial Sequence
  dgRNA
  Hilpda
acgcccgggcagtgt

SEQ ID NO: 69859 - DNA, 15 bp, Artificial Sequence
  dgRNA
  Hilpda
gacgcccgggcagtg

SEQ ID NO: 69860 - DNA, 15 bp, Artificial Sequence
  dgRNA
  Rbpms2
ctggggaccgggccg

SEQ ID NO: 69861 - DNA, 15 bp, Artificial Sequence
  dgRNA
  Rbpms2
ggggcgagcccgcac

SEQ ID NO: 69862 - DNA, 15 bp, Artificial Sequence
  dgRNA
  Rbpms2
gggcgagcccgcact

SEQ ID NO: 69863 - DNA, 15 bp, Artificial Sequence
  dgRNA
  Rbpms2
gcccgcactgggctg

SEQ ID NO: 69864 - DNA, 15 bp, Artificial Sequence
  dgRNA
  Slc39a7
tgcgtcctgacgccg

SEQ ID NO: 69865 - DNA, 15 bp, Artificial Sequence
  dgRNA
  Slc39a7
tggccgcgccgccct

SEQ ID NO: 69866 - DNA, 15 bp, Artificial Sequence
  dgRNA
  Slc39a7
ggccgcgccgccctc

SEQ ID NO: 69867 - DNA, 15 bp, Artificial Sequence
  dgRNA
  Slc39a7
ggggcgccgccatgt

SEQ ID NO: 69868 - DNA, 15 bp, Artificial Sequence
  dgRNA
  Uhrf1bp1l
gtaccaactaggaaa

SEQ ID NO: 69869 - DNA, 15 bp, Artificial Sequence
  dgRNA
  Uhrf1bp1l
cagcggaggacctag

SEQ ID NO: 69870 - DNA, 15 bp, Artificial Sequence
  dgRNA
  Uhrf1bp1l
agcggaggacctagt

SEQ ID NO: 69871 - DNA, 15 bp, Artificial Sequence
  dgRNA
  Uhrf1bp1l
gtgggagtccgaagt

SEQ ID NO: 69872 - DNA, 15 bp, Artificial Sequence
  dgRNA
  Col23a1
cgacagagccgagcc

SEQ ID NO: 69873 - DNA, 15 bp, Artificial Sequence
  dgRNA
  Col23a1
cgagcccggccgcat

SEQ ID NO: 69874 - DNA, 15 bp, Artificial Sequence
  dgRNA
  Col23a1
gagcccggccgcata

SEQ ID NO: 69875 - DNA, 15 bp, Artificial Sequence
  dgRNA
  Col23a1
ccgcatagggtgcct

SEQ ID NO: 69876 - DNA, 15 bp, Artificial Sequence
  dgRNA
  Stat5b
attgcgtactagctg

SEQ ID NO: 69877 - DNA, 15 bp, Artificial Sequence
  dgRNA
  Stat5b
gcgtactagctgcgg

SEQ ID NO: 69878 - DNA, 15 bp, Artificial Sequence
  dgRNA
  Stat5b
cgtactagctgcgga

SEQ ID NO: 69879 - DNA, 15 bp, Artificial Sequence
  dgRNA
  Stat5b
gtactagctgcggag

SEQ ID NO: 69880 - DNA, 15 bp, Artificial Sequence
  dgRNA
  Hesx1
cctaaatgtacaggg

SEQ ID NO: 69881 - DNA, 15 bp, Artificial Sequence
  dgRNA
  Hesx1
gatacctaaatgtac

SEQ ID NO: 69882 - DNA, 15 bp, Artificial Sequence
  dgRNA
  Pdk4
gccccttgcaggcca

SEQ ID NO: 69883 - DNA, 15 bp, Artificial Sequence
  dgRNA
  Pdk4
ccatggaaaccgtgt

SEQ ID NO: 69884 - DNA, 15 bp, Artificial Sequence
  dgRNA
  Pdk4
catggaaaccgtgtc

SEQ ID NO: 69885 - DNA, 15 bp, Artificial Sequence
  dgRNA
  Pdk4
cgggatcactgtgcc

SEQ ID NO: 69886 - DNA, 15 bp, Artificial Sequence
  dgRNA
  Pcdha8
tatgtacttactctt

SEQ ID NO: 69887 - DNA, 15 bp, Artificial Sequence
  dgRNA
  Pcdha8
gcctgatgtcgctct

SEQ ID NO: 69888 - DNA, 15 bp, Artificial Sequence
  dgRNA
  Pcdha8
atagcacctttttcc

SEQ ID NO: 69889 - DNA, 15 bp, Artificial Sequence
  dgRNA
  Pcdha8
gagtaagtacatatt

SEQ ID NO: 69890 - DNA, 15 bp, Artificial Sequence
  dgRNA
  P4htm
aactactagttgcaa

SEQ ID NO: 69891 - DNA, 15 bp, Artificial Sequence
  dgRNA
  P4htm
ccataaacgaccagc

SEQ ID NO: 69892 - DNA, 15 bp, Artificial Sequence
  dgRNA
  P4htm
cataaacgaccagcc

SEQ ID NO: 69893 - DNA, 15 bp, Artificial Sequence
  dgRNA
  P4htm
agccgggtgtgagcg

SEQ ID NO: 69894 - DNA, 15 bp, Artificial Sequence
  dgRNA
  Zfp595
aacttaacctactca

SEQ ID NO: 69895 - DNA, 15 bp, Artificial Sequence
  dgRNA
  Zfp595
acttaacctactcac

SEQ ID NO: 69896 - DNA, 15 bp, Artificial Sequence
  dgRNA
  Zfp595
taacctactcacggg

SEQ ID NO: 69897 - DNA, 15 bp, Artificial Sequence
  dgRNA
  Zfp595
ctactcacgggtggc

SEQ ID NO: 69898 - DNA, 15 bp, Artificial Sequence
  dgRNA
  Herc6
caagcaggcacttac

SEQ ID NO: 69899 - DNA, 15 bp, Artificial Sequence
  dgRNA
  Herc6
aagaactatgacgta

SEQ ID NO: 69900 - DNA, 15 bp, Artificial Sequence
  dgRNA
  Herc6
agaactatgacgtaa

SEQ ID NO: 69901 - DNA, 15 bp, Artificial Sequence
  dgRNA
  Herc6
tatgacgtaagggac

SEQ ID NO: 69902 - DNA, 15 bp, Artificial Sequence
  dgRNA
  Ipo7
ttcactgactacagt

SEQ ID NO: 69903 - DNA, 15 bp, Artificial Sequence
  dgRNA
  Ipo7
ggccgtgtccgcgtt

SEQ ID NO: 69904 - DNA, 15 bp, Artificial Sequence
  dgRNA
  Ipo7
gccgtgtccgcgttt

SEQ ID NO: 69905 - DNA, 15 bp, Artificial Sequence
  dgRNA
  Ipo7
ccgtgtccgcgtttg

SEQ ID NO: 69906 - DNA, 15 bp, Artificial Sequence
  dgRNA
  Zkscan5
gagcccgcccccttg

SEQ ID NO: 69907 - DNA, 15 bp, Artificial Sequence
  dgRNA
  Erbb3
ctcttggccaagctg

SEQ ID NO: 69908 - DNA, 15 bp, Artificial Sequence
  dgRNA
  Erbb3
ctggcggggcacgct

SEQ ID NO: 69909 - DNA, 15 bp, Artificial Sequence
  dgRNA
  Erbb3
tggcggggcacgctt

SEQ ID NO: 69910 - DNA, 15 bp, Artificial Sequence
  dgRNA
  Erbb3
cggggcacgcttggg

SEQ ID NO: 69911 - DNA, 15 bp, Artificial Sequence
  dgRNA
  Wbscr28
ttttttcccgatagt

SEQ ID NO: 69912 - DNA, 15 bp, Artificial Sequence
  dgRNA
  Wbscr28
agacaattgatccta

SEQ ID NO: 69913 - DNA, 15 bp, Artificial Sequence
  dgRNA
  Wbscr28
gggtagtgtgtcatg

SEQ ID NO: 69914 - DNA, 15 bp, Artificial Sequence
  dgRNA
  Wbscr28
gtgtcatgtggcaac

SEQ ID NO: 69915 - DNA, 15 bp, Artificial Sequence
  dgRNA
  Isg15
tttaaggtatgccgt

SEQ ID NO: 69916 - DNA, 15 bp, Artificial Sequence
  dgRNA
  Isg15
gtatgccgtaggaaa

SEQ ID NO: 69917 - DNA, 15 bp, Artificial Sequence
  dgRNA
  Isg15
ccctaaacgcccttc

SEQ ID NO: 69918 - DNA, 15 bp, Artificial Sequence
  dgRNA
  Isg15
gtcaaagctgtaacc

SEQ ID NO: 69919 - DNA, 15 bp, Artificial Sequence
  dgRNA
  2810403A07Rik
agccggagagtcgac

SEQ ID NO: 69920 - DNA, 15 bp, Artificial Sequence
  dgRNA
  2810403A07Rik
ggagagtcgacaggc

SEQ ID NO: 69921 - DNA, 15 bp, Artificial Sequence
  dgRNA
  2810403A07Rik
cgctttaaatcaccg

SEQ ID NO: 69922 - DNA, 15 bp, Artificial Sequence
  dgRNA
  2810403A07Rik
gctttaaatcaccga

SEQ ID NO: 69923 - DNA, 15 bp, Artificial Sequence
  dgRNA
  Mid2
ttgcttaagcgtccc

SEQ ID NO: 69924 - DNA, 15 bp, Artificial Sequence
  dgRNA
  Mid2
tgcttaagcgtccct

SEQ ID NO: 69925 - DNA, 15 bp, Artificial Sequence
  dgRNA
  Mid2
gcttaagcgtccctg

SEQ ID NO: 69926 - DNA, 15 bp, Artificial Sequence
  dgRNA
  Mid2
cctggggagtctatc

SEQ ID NO: 69927 - DNA, 15 bp, Artificial Sequence
  dgRNA
  Tor2a
agttacccgtgacca

SEQ ID NO: 69928 - DNA, 15 bp, Artificial Sequence
  dgRNA
  Tor2a
tgaccatggcaacgc

SEQ ID NO: 69929 - DNA, 15 bp, Artificial Sequence
  dgRNA
  Tor2a
atggcaacgcgggac

SEQ ID NO: 69930 - DNA, 15 bp, Artificial Sequence
  dgRNA
  Tor2a
tggcaacgcgggact

SEQ ID NO: 69931 - DNA, 15 bp, Artificial Sequence
  dgRNA
  Pick1
actaacgctttgtag

SEQ ID NO: 69932 - DNA, 15 bp, Artificial Sequence
  dgRNA
  Pick1
aacgctttgtagtgg

SEQ ID NO: 69933 - DNA, 15 bp, Artificial Sequence
  dgRNA
  Pick1
atgctcccgttgccc

SEQ ID NO: 69934 - DNA, 15 bp, Artificial Sequence
  dgRNA
  Pick1
ttgccctggcaaccg

SEQ ID NO: 69935 - DNA, 15 bp, Artificial Sequence
  dgRNA
  Wdr92
tatgtaaagtcgttg

SEQ ID NO: 69936 - DNA, 15 bp, Artificial Sequence
  dgRNA
  Wdr92
aagtcgttgtggtaa

SEQ ID NO: 69937 - DNA, 15 bp, Artificial Sequence
  dgRNA
  Wdr92
ctcacacggcatttt

SEQ ID NO: 69938 - DNA, 15 bp, Artificial Sequence
  dgRNA
  Wdr92
acacggcattttcgg

SEQ ID NO: 69939 - DNA, 15 bp, Artificial Sequence
  dgRNA
  Rab21
accattcctcgggcc

SEQ ID NO: 69940 - DNA, 15 bp, Artificial Sequence
  dgRNA
  Rab21
ccaccgcaggattcc

SEQ ID NO: 69941 - DNA, 15 bp, Artificial Sequence
  dgRNA
  Rab21
caccgcaggattccc

SEQ ID NO: 69942 - DNA, 15 bp, Artificial Sequence
  dgRNA
  Rab21
ctgagccggttcgtg

SEQ ID NO: 69943 - DNA, 15 bp, Artificial Sequence
  dgRNA
  Slc39a8
tatatttgaacctca

SEQ ID NO: 69944 - DNA, 15 bp, Artificial Sequence
  dgRNA
  Zbtb33
aatgcttcgcagtca

SEQ ID NO: 69945 - DNA, 15 bp, Artificial Sequence
  dgRNA
  Zbtb33
cacggaaagagccga

SEQ ID NO: 69946 - DNA, 15 bp, Artificial Sequence
  dgRNA
  Zbtb33
ggaaagagccgaagg

SEQ ID NO: 69947 - DNA, 15 bp, Artificial Sequence
  dgRNA
  Zbtb33
gaaagagccgaaggc

SEQ ID NO: 69948 - DNA, 15 bp, Artificial Sequence
  dgRNA
  Junb
ccgcgcagagccacc

SEQ ID NO: 69949 - DNA, 15 bp, Artificial Sequence
  dgRNA
  Junb
gagccacccggctcg

SEQ ID NO: 69950 - DNA, 15 bp, Artificial Sequence
  dgRNA
  Junb
tggccgctgtttaca

SEQ ID NO: 69951 - DNA, 15 bp, Artificial Sequence
  dgRNA
  Junb
tccccacgctctagg

SEQ ID NO: 69952 - DNA, 15 bp, Artificial Sequence
  dgRNA
  Zfp14
cagtgagctaggttt

SEQ ID NO: 69953 - DNA, 15 bp, Artificial Sequence
  dgRNA
  Zfp14
caagatcacacccag

SEQ ID NO: 69954 - DNA, 15 bp, Artificial Sequence
  dgRNA
  Zfp14
cgcactccgctgcgt

SEQ ID NO: 69955 - DNA, 15 bp, Artificial Sequence
  dgRNA
  Zfp14
caaacctagctcact

SEQ ID NO: 69956 - DNA, 15 bp, Artificial Sequence
  dgRNA
  Zdbf2
tggggcggcgcctgc

SEQ ID NO: 69957 - DNA, 15 bp, Artificial Sequence
  dgRNA
  Zdbf2
tgtgcgctttaagag

SEQ ID NO: 69958 - DNA, 15 bp, Artificial Sequence
  dgRNA
  Zdbf2
gtgcgctttaagagc

SEQ ID NO: 69959 - DNA, 15 bp, Artificial Sequence
  dgRNA
  Zdbf2
cgctttaagagcggg

SEQ ID NO: 69960 - DNA, 15 bp, Artificial Sequence
  dgRNA
  Gpd2
gcacgaggagctttt

SEQ ID NO: 69961 - DNA, 15 bp, Artificial Sequence
  dgRNA
  Gpd2
caacaccataatctc

SEQ ID NO: 69962 - DNA, 15 bp, Artificial Sequence
  dgRNA
  Gpd2
gccaaattagtttga

SEQ ID NO: 69963 - DNA, 15 bp, Artificial Sequence
  dgRNA
  Gpd2
caagggtacccaagg

SEQ ID NO: 69964 - DNA, 15 bp, Artificial Sequence
  dgRNA
  Snx25
agtgtaatcttactc

SEQ ID NO: 69965 - DNA, 15 bp, Artificial Sequence
  dgRNA
  Klhl24
ttggaattagcagcc

SEQ ID NO: 69966 - DNA, 15 bp, Artificial Sequence
  dgRNA
  Klhl24
tggaattagcagccc

SEQ ID NO: 69967 - DNA, 15 bp, Artificial Sequence
  dgRNA
  Klhl24
ggaattagcagcccg

SEQ ID NO: 69968 - DNA, 15 bp, Artificial Sequence
  dgRNA
  Klhl24
ttagcagcccggggt

SEQ ID NO: 69969 - DNA, 15 bp, Artificial Sequence
  dgRNA
  Trappc2
ctgctccgcccgctc

SEQ ID NO: 69970 - DNA, 15 bp, Artificial Sequence
  dgRNA
  Trappc2
cccgctccggccgct

SEQ ID NO: 69971 - DNA, 15 bp, Artificial Sequence
  dgRNA
  Trappc2
gccgctcggcccgct

SEQ ID NO: 69972 - DNA, 15 bp, Artificial Sequence
  dgRNA
  Trappc2
ctcggcccgctcggc

SEQ ID NO: 69973 - DNA, 15 bp, Artificial Sequence
  dgRNA
  Guca2a
gtcacagtagtgccc

SEQ ID NO: 69974 - DNA, 15 bp, Artificial Sequence
  dgRNA
  Guca2a
tcacagtagtgccca

SEQ ID NO: 69975 - DNA, 15 bp, Artificial Sequence
  dgRNA
  Guca2a
ttggccttatctgat

SEQ ID NO: 69976 - DNA, 15 bp, Artificial Sequence
  dgRNA
  Guca2a
tggccttatctgatg

SEQ ID NO: 69977 - DNA, 15 bp, Artificial Sequence
  dgRNA
  Ecm2
agcgggagttgggcg

SEQ ID NO: 69978 - DNA, 15 bp, Artificial Sequence
  dgRNA
  Ecm2
cagcgggagttgggc

SEQ ID NO: 69979 - DNA, 15 bp, Artificial Sequence
  dgRNA
  Ecm2
tcagcgggagttggg

SEQ ID NO: 69980 - DNA, 15 bp, Artificial Sequence
  dgRNA
  Ecm2
acatcagcgggagtt

SEQ ID NO: 69981 - DNA, 15 bp, Artificial Sequence
  dgRNA
  Stpg1
cgaaccccaaaattc

SEQ ID NO: 69982 - DNA, 15 bp, Artificial Sequence
  dgRNA
  Stpg1
aacgtctccaacgat

SEQ ID NO: 69983 - DNA, 15 bp, Artificial Sequence
  dgRNA
  Stpg1
ccagttgcctgccgc

SEQ ID NO: 69984 - DNA, 15 bp, Artificial Sequence
  dgRNA
  Stpg1
cctgccgccggactc

SEQ ID NO: 69985 - DNA, 15 bp, Artificial Sequence
  dgRNA
  Lrrc2
gaccatcagtagccc

SEQ ID NO: 69986 - DNA, 15 bp, Artificial Sequence
  dgRNA
  Lrrc2
atttagtaatgtcca

SEQ ID NO: 69987 - DNA, 15 bp, Artificial Sequence
  dgRNA
  Lrrc2
ctacatacatcgtga

SEQ ID NO: 69988 - DNA, 15 bp, Artificial Sequence
  dgRNA
  Lrrc2
tacatacatcgtgaa

SEQ ID NO: 69989 - DNA, 15 bp, Artificial Sequence
  dgRNA
  P2rx2
tactgtcacaaaggg

SEQ ID NO: 69990 - DNA, 15 bp, Artificial Sequence
  dgRNA
  P2rx2
cagcctgcccacgag

SEQ ID NO: 69991 - DNA, 15 bp, Artificial Sequence
  dgRNA
  P2rx2
atcacaactccagtt

SEQ ID NO: 69992 - DNA, 15 bp, Artificial Sequence
  dgRNA
  P2rx2
actgcaggtgcggcg

SEQ ID NO: 69993 - DNA, 15 bp, Artificial Sequence
  dgRNA
  Scp2
gaagcacagaaaccg

SEQ ID NO: 69994 - DNA, 15 bp, Artificial Sequence
  dgRNA
  Scp2
tgagtctaacacagt

SEQ ID NO: 69995 - DNA, 15 bp, Artificial Sequence
  dgRNA
  Scp2
aacccataaaggact

SEQ ID NO: 69996 - DNA, 15 bp, Artificial Sequence
  dgRNA
  Scp2
tcggttcccgtaact

SEQ ID NO: 69997 - DNA, 15 bp, Artificial Sequence
  dgRNA
  Sobp
cgcgtctacaacgac

SEQ ID NO: 69998 - DNA, 15 bp, Artificial Sequence
  dgRNA
  Sobp
gcgtctacaacgacc

SEQ ID NO: 69999 - DNA, 15 bp, Artificial Sequence
  dgRNA
  Sobp
acgcccgctcgcgag

SEQ ID NO: 70000 - DNA, 15 bp, Artificial Sequence
  dgRNA
  Sobp
cgcccgctcgcgagc

SEQ ID NO: 70001 - DNA, 15 bp, Artificial Sequence
  dgRNA
  Ralyl
ttgctcgctgacaga

SEQ ID NO: 70002 - DNA, 15 bp, Artificial Sequence
  dgRNA
  Ticrr
ttaaaacgaaggctc

SEQ ID NO: 70003 - DNA, 15 bp, Artificial Sequence
  dgRNA
  Ticrr
cctccaccaatcaag

SEQ ID NO: 70004 - DNA, 15 bp, Artificial Sequence
  dgRNA
  Ticrr
ccaccaatcaagcgg

SEQ ID NO: 70005 - DNA, 15 bp, Artificial Sequence
  dgRNA
  Ticrr
acacgccttccagtt

SEQ ID NO: 70006 - DNA, 15 bp, Artificial Sequence
  dgRNA
  Olfr145
tcctttctaacctaa

SEQ ID NO: 70007 - DNA, 15 bp, Artificial Sequence
  dgRNA
  Olfr145
aattctctagactcc

SEQ ID NO: 70008 - DNA, 15 bp, Artificial Sequence
  dgRNA
  Olfr145
ctcaagtctttaatt

SEQ ID NO: 70009 - DNA, 15 bp, Artificial Sequence
  dgRNA
  Olfr145
tcctttaggttagaa

SEQ ID NO: 70010 - DNA, 15 bp, Artificial Sequence
  dgRNA
  Gtf2f2
agattgcacgttgcc

SEQ ID NO: 70011 - DNA, 15 bp, Artificial Sequence
  dgRNA
  Gtf2f2
gagtcacgcccatct

SEQ ID NO: 70012 - DNA, 15 bp, Artificial Sequence
  dgRNA
  Gtf2f2
catctaggaaattgc

SEQ ID NO: 70013 - DNA, 15 bp, Artificial Sequence
  dgRNA
  Gtf2f2
ggaaattgccggagc

SEQ ID NO: 70014 - DNA, 15 bp, Artificial Sequence
  dgRNA
  Akr1c13
ggctaactgccagaa

SEQ ID NO: 70015 - DNA, 15 bp, Artificial Sequence
  dgRNA
  Akr1c13
gctaactgccagaaa

SEQ ID NO: 70016 - DNA, 15 bp, Artificial Sequence
  dgRNA
  Akr1c13
gggacactccctttc

SEQ ID NO: 70017 - DNA, 15 bp, Artificial Sequence
  dgRNA
  Akr1c13
tctaatggttaacaa

SEQ ID NO: 70018 - DNA, 15 bp, Artificial Sequence
  dgRNA
  Art3
gcctcttatagtcat

SEQ ID NO: 70019 - DNA, 15 bp, Artificial Sequence
  dgRNA
  Art3
cattcaatgttatcc

SEQ ID NO: 70020 - DNA, 15 bp, Artificial Sequence
  dgRNA
  Art3
tcctatgactataag

SEQ ID NO: 70021 - DNA, 15 bp, Artificial Sequence
  dgRNA
  Art3
aaacggaactggata

SEQ ID NO: 70022 - DNA, 15 bp, Artificial Sequence
  dgRNA
  Lpar3
ggcagagcgcctcca

SEQ ID NO: 70023 - DNA, 15 bp, Artificial Sequence
  dgRNA
  Lpar3
gcctccatggaccgc

SEQ ID NO: 70024 - DNA, 15 bp, Artificial Sequence
  dgRNA
  Lpar3
gtgccgatccgagcc

SEQ ID NO: 70025 - DNA, 15 bp, Artificial Sequence
  dgRNA
  Lpar3
cgatccgagcctggc

SEQ ID NO: 70026 - DNA, 15 bp, Artificial Sequence
  dgRNA
  Usp10
caggagtacaattcc

SEQ ID NO: 70027 - DNA, 15 bp, Artificial Sequence
  dgRNA
  Usp10
aagacagtctgtagt

SEQ ID NO: 70028 - DNA, 15 bp, Artificial Sequence
  dgRNA
  Usp10
tcccctggcgtcatg

SEQ ID NO: 70029 - DNA, 15 bp, Artificial Sequence
  dgRNA
  Usp10
agaactcgttaatcc

SEQ ID NO: 70030 - DNA, 15 bp, Artificial Sequence
  dgRNA
  Cyfip1
ccttagcttcaacag

SEQ ID NO: 70031 - DNA, 15 bp, Artificial Sequence
  dgRNA
  Cyfip1
gaggtcccccaaatc

SEQ ID NO: 70032 - DNA, 15 bp, Artificial Sequence
  dgRNA
  Cyfip1
aggtcccccaaatca

SEQ ID NO: 70033 - DNA, 15 bp, Artificial Sequence
  dgRNA
  Adh5
gaataaagcgcttca

SEQ ID NO: 70034 - DNA, 15 bp, Artificial Sequence
  dgRNA
  Adh5
cagtagccgaaactc

SEQ ID NO: 70035 - DNA, 15 bp, Artificial Sequence
  dgRNA
  Adh5
tcaggctccgaaacg

SEQ ID NO: 70036 - DNA, 15 bp, Artificial Sequence
  dgRNA
  Adh5
caggctccgaaacgc

SEQ ID NO: 70037 - DNA, 15 bp, Artificial Sequence
  dgRNA
  Rasal1
gataatccccatgaa

SEQ ID NO: 70038 - DNA, 15 bp, Artificial Sequence
  dgRNA
  Rasal1
ggctcaagccgtgcc

SEQ ID NO: 70039 - DNA, 15 bp, Artificial Sequence
  dgRNA
  Rasal1
gccgtgcctggaact

SEQ ID NO: 70040 - DNA, 15 bp, Artificial Sequence
  dgRNA
  Rasal1
ttggttaagtgttcg

SEQ ID NO: 70041 - DNA, 15 bp, Artificial Sequence
  dgRNA
  1110032F04Rik
ctctgttcatctccg

SEQ ID NO: 70042 - DNA, 15 bp, Artificial Sequence
  dgRNA
  1110032F04Rik
tccgcacgcttctcc

SEQ ID NO: 70043 - DNA, 15 bp, Artificial Sequence
  dgRNA
  1110032F04Rik
ccgcacgcttctccc

SEQ ID NO: 70044 - DNA, 15 bp, Artificial Sequence
  dgRNA
  1110032F04Rik
ggcgcccaggcgcta

SEQ ID NO: 70045 - DNA, 15 bp, Artificial Sequence
  dgRNA
  Paip1
ccccgggcagacgac

SEQ ID NO: 70046 - DNA, 15 bp, Artificial Sequence
  dgRNA
  Paip1
cccgggcagacgaca

SEQ ID NO: 70047 - DNA, 15 bp, Artificial Sequence
  dgRNA
  Paip1
acagggcagcgtccc

SEQ ID NO: 70048 - DNA, 15 bp, Artificial Sequence
  dgRNA
  Paip1
gcccccttcgccgcc

SEQ ID NO: 70049 - DNA, 15 bp, Artificial Sequence
  dgRNA
  Arfip1
ggagaccgggttgag

SEQ ID NO: 70050 - DNA, 15 bp, Artificial Sequence
  dgRNA
  Arfip1
cgggttgagaggtcg

SEQ ID NO: 70051 - DNA, 15 bp, Artificial Sequence
  dgRNA
  Arfip1
gggttgagaggtcgc

SEQ ID NO: 70052 - DNA, 15 bp, Artificial Sequence
  dgRNA
  Arfip1
agtgtcctcggcggt

SEQ ID NO: 70053 - DNA, 15 bp, Artificial Sequence
  dgRNA
  Aldh1a2
agcgcggtcccgccg

SEQ ID NO: 70054 - DNA, 15 bp, Artificial Sequence
  dgRNA
  Aldh1a2
gccgaggctgcgctc

SEQ ID NO: 70055 - DNA, 15 bp, Artificial Sequence
  dgRNA
  Aldh1a2
gcgctccggccgtcg

SEQ ID NO: 70056 - DNA, 15 bp, Artificial Sequence
  dgRNA
  Aldh1a2
ccgtcgaggcccccc

SEQ ID NO: 70057 - DNA, 15 bp, Artificial Sequence
  dgRNA
  Dnajb7
taaggctcagtaatc

SEQ ID NO: 70058 - DNA, 15 bp, Artificial Sequence
  dgRNA
  Dnajb7
ggctcagtaatctgg

SEQ ID NO: 70059 - DNA, 15 bp, Artificial Sequence
  dgRNA
  Dnajb7
tcgcacagaatgact

SEQ ID NO: 70060 - DNA, 15 bp, Artificial Sequence
  dgRNA
  Dnajb7
cgcacagaatgactt

SEQ ID NO: 70061 - DNA, 15 bp, Artificial Sequence
  dgRNA
  Golga3
ggaagccacgccccg

SEQ ID NO: 70062 - DNA, 15 bp, Artificial Sequence
  dgRNA
  Golga3
gaagccacgccccgg

SEQ ID NO: 70063 - DNA, 15 bp, Artificial Sequence
  dgRNA
  Golga3
tacccaccagtcaga

SEQ ID NO: 70064 - DNA, 15 bp, Artificial Sequence
  dgRNA
  Golga3
agtcagaaggccgcg

SEQ ID NO: 70065 - DNA, 15 bp, Artificial Sequence
  dgRNA
  Jade1
agtgtgtttgcgagt

SEQ ID NO: 70066 - DNA, 15 bp, Artificial Sequence
  dgRNA
  Jade1
gtgtgtttgcgagtt

SEQ ID NO: 70067 - DNA, 15 bp, Artificial Sequence
  dgRNA
  Jade1
tgttcggtagccagt

SEQ ID NO: 70068 - DNA, 15 bp, Artificial Sequence
  dgRNA
  Jade1
agccagtaggctttc

SEQ ID NO: 70069 - DNA, 15 bp, Artificial Sequence
  dgRNA
  Tnfrsf9
ttcctaaagtcgtcc

SEQ ID NO: 70070 - DNA, 15 bp, Artificial Sequence
  dgRNA
  Tnfrsf9
attttgagggtagcg

SEQ ID NO: 70071 - DNA, 15 bp, Artificial Sequence
  dgRNA
  Tnfrsf9
ttcctggacgacttt

SEQ ID NO: 70072 - DNA, 15 bp, Artificial Sequence
  dgRNA
  Tnfrsf9
cattaggacgtttcc

SEQ ID NO: 70073 - DNA, 15 bp, Artificial Sequence
  dgRNA
  Cdk5r2
gaagactccaggcgg

SEQ ID NO: 70074 - DNA, 15 bp, Artificial Sequence
  dgRNA
  Cdk5r2
aagactccaggcggt

SEQ ID NO: 70075 - DNA, 15 bp, Artificial Sequence
  dgRNA
  Cdk5r2
tccaggcggtgggta

SEQ ID NO: 70076 - DNA, 15 bp, Artificial Sequence
  dgRNA
  Cdk5r2
tatgcaacatcctat

SEQ ID NO: 70077 - DNA, 15 bp, Artificial Sequence
  dgRNA
  Atg101
agtactaaagttacg

SEQ ID NO: 70078 - DNA, 15 bp, Artificial Sequence
  dgRNA
  Atg101
agcttcctgatgtcg

SEQ ID NO: 70079 - DNA, 15 bp, Artificial Sequence
  dgRNA
  Atg101
atgtcgtggctgcag

SEQ ID NO: 70080 - DNA, 15 bp, Artificial Sequence
  dgRNA
  Atg101
gcagcggcgtccggc

SEQ ID NO: 70081 - DNA, 15 bp, Artificial Sequence
  dgRNA
  Rcor2
agtaccttctatcgg

SEQ ID NO: 70082 - DNA, 15 bp, Artificial Sequence
  dgRNA
  Rcor2
gtaccttctatcgga

SEQ ID NO: 70083 - DNA, 15 bp, Artificial Sequence
  dgRNA
  Rcor2
ctatcggagggtagc

SEQ ID NO: 70084 - DNA, 15 bp, Artificial Sequence
  dgRNA
  Rcor2
tatcggagggtagct

SEQ ID NO: 70085 - DNA, 15 bp, Artificial Sequence
  dgRNA
  Calhm2
gcaagatctccttga

SEQ ID NO: 70086 - DNA, 15 bp, Artificial Sequence
  dgRNA
  Calhm2
cttgagggccctgcc

SEQ ID NO: 70087 - DNA, 15 bp, Artificial Sequence
  dgRNA
  Calhm2
cccagatggcccccg

SEQ ID NO: 70088 - DNA, 15 bp, Artificial Sequence
  dgRNA
  Calhm2
ccagatggcccccga

SEQ ID NO: 70089 - DNA, 15 bp, Artificial Sequence
  dgRNA
  Slc39a1
ggggcccaccgccct

SEQ ID NO: 70090 - DNA, 15 bp, Artificial Sequence
  dgRNA
  Slc39a1
gggcccaccgccctc

SEQ ID NO: 70091 - DNA, 15 bp, Artificial Sequence
  dgRNA
  Slc39a1
ccgctagtcccctcc

SEQ ID NO: 70092 - DNA, 15 bp, Artificial Sequence
  dgRNA
  Slc39a1
gtcccctcccggttc

SEQ ID NO: 70093 - DNA, 15 bp, Artificial Sequence
  dgRNA
  Otud4
gcgggaaggggcgcc

SEQ ID NO: 70094 - DNA, 15 bp, Artificial Sequence
  dgRNA
  Otud4
agcgggaaggggcgc

SEQ ID NO: 70095 - DNA, 15 bp, Artificial Sequence
  dgRNA
  Otud4
cggagggcgcctgag

SEQ ID NO: 70096 - DNA, 15 bp, Artificial Sequence
  dgRNA
  Mageb1
cgagttcagaagtcc

SEQ ID NO: 70097 - DNA, 15 bp, Artificial Sequence
  dgRNA
  Ppp1r14c
ttcccaatcctacag

SEQ ID NO: 70098 - DNA, 15 bp, Artificial Sequence
  dgRNA
  Ppp1r14c
ggtcatggcgtgaat

SEQ ID NO: 70099 - DNA, 15 bp, Artificial Sequence
  dgRNA
  Ppp1r14c
gtgtgtttagagccg

SEQ ID NO: 70100 - DNA, 15 bp, Artificial Sequence
  dgRNA
  Ppp1r14c
tgtgtttagagccgc

SEQ ID NO: 70101 - DNA, 15 bp, Artificial Sequence
  dgRNA
  Gm11567
attgtggataattca

SEQ ID NO: 70102 - DNA, 15 bp, Artificial Sequence
  dgRNA
  Ift80
ccaataacaccttcc

SEQ ID NO: 70103 - DNA, 15 bp, Artificial Sequence
  dgRNA
  Ift80
agggcgggctcggtt

SEQ ID NO: 70104 - DNA, 15 bp, Artificial Sequence
  dgRNA
  Ift80
gggcgggctcggtta

SEQ ID NO: 70105 - DNA, 15 bp, Artificial Sequence
  dgRNA
  Ift80
ggcgggctcggttag

SEQ ID NO: 70106 - DNA, 15 bp, Artificial Sequence
  dgRNA
  Syt11
cctacacttcttaat

SEQ ID NO: 70107 - DNA, 15 bp, Artificial Sequence
  dgRNA
  Syt11
cccattaagaagtgt

SEQ ID NO: 70108 - DNA, 15 bp, Artificial Sequence
  dgRNA
  Syt11
ggctgtgggcgtttg

SEQ ID NO: 70109 - DNA, 15 bp, Artificial Sequence
  dgRNA
  Ufc1
ttaattattcaggac

SEQ ID NO: 70110 - DNA, 15 bp, Artificial Sequence
  dgRNA
  Ufc1
taaattgcgcatctt

SEQ ID NO: 70111 - DNA, 15 bp, Artificial Sequence
  dgRNA
  Ufc1
cgcatcttaggagat

SEQ ID NO: 70112 - DNA, 15 bp, Artificial Sequence
  dgRNA
  Ufc1
acaactttgctggtt

SEQ ID NO: 70113 - DNA, 15 bp, Artificial Sequence
  dgRNA
  AF366264
aattcttcggacatc

SEQ ID NO: 70114 - DNA, 15 bp, Artificial Sequence
  dgRNA
  Klb
gaaaacgccattctc

SEQ ID NO: 70115 - DNA, 15 bp, Artificial Sequence
  dgRNA
  Klb
cgccattctcaggca

SEQ ID NO: 70116 - DNA, 15 bp, Artificial Sequence
  dgRNA
  Klb
ttcaaattagtgtcc

SEQ ID NO: 70117 - DNA, 15 bp, Artificial Sequence
  dgRNA
  Klb
tcaaattagtgtccg

SEQ ID NO: 70118 - DNA, 15 bp, Artificial Sequence
  dgRNA
  Tmem92
agtgagatctaatcc

SEQ ID NO: 70119 - DNA, 15 bp, Artificial Sequence
  dgRNA
  Vmn2r6
tagcagttacagtct

SEQ ID NO: 70120 - DNA, 15 bp, Artificial Sequence
  dgRNA
  Olfr723
tataaccttatatgc

SEQ ID NO: 70121 - DNA, 15 bp, Artificial Sequence
  dgRNA
  Olfr723
cacatccagcatata

SEQ ID NO: 70122 - DNA, 15 bp, Artificial Sequence
  dgRNA
  Prkaa1
gccgcctagcccgcc

SEQ ID NO: 70123 - DNA, 15 bp, Artificial Sequence
  dgRNA
  Prkaa1
ccgcctagcccgcca

SEQ ID NO: 70124 - DNA, 15 bp, Artificial Sequence
  dgRNA
  Prkaa1
cgcctagcccgccag

SEQ ID NO: 70125 - DNA, 15 bp, Artificial Sequence
  dgRNA
  Prkaa1
gcctagcccgccagg

SEQ ID NO: 70126 - DNA, 15 bp, Artificial Sequence
  dgRNA
  Prkd2
ccctctcgcgtgccg

SEQ ID NO: 70127 - DNA, 15 bp, Artificial Sequence
  dgRNA
  Prkd2
tgccgcggtgaactg

SEQ ID NO: 70128 - DNA, 15 bp, Artificial Sequence
  dgRNA
  Prkd2
gcgctttgtcattga

SEQ ID NO: 70129 - DNA, 15 bp, Artificial Sequence
  dgRNA
  Prkd2
gcacgcgagaggggc

SEQ ID NO: 70130 - DNA, 15 bp, Artificial Sequence
  dgRNA
  Hoxa2
taaataaagcctcga

SEQ ID NO: 70131 - DNA, 15 bp, Artificial Sequence
  dgRNA
  Hoxa2
cgatggcccccaatg

SEQ ID NO: 70132 - DNA, 15 bp, Artificial Sequence
  dgRNA
  Hoxa2
gcccaaattgtcatt

SEQ ID NO: 70133 - DNA, 15 bp, Artificial Sequence
  dgRNA
  Hoxa2
atgtgacagccaatt

SEQ ID NO: 70134 - DNA, 15 bp, Artificial Sequence
  dgRNA
  Mrm1
cccgggagcagtcca

SEQ ID NO: 70135 - DNA, 15 bp, Artificial Sequence
  dgRNA
  Mrm1
gctcgcctgcgtcag

SEQ ID NO: 70136 - DNA, 15 bp, Artificial Sequence
  dgRNA
  Mrm1
cgcctgcgtcagcgg

SEQ ID NO: 70137 - DNA, 15 bp, Artificial Sequence
  dgRNA
  Mrm1
gcgactcactcctgt

SEQ ID NO: 70138 - DNA, 15 bp, Artificial Sequence
  dgRNA
  Slc14a1
gttcaagttgagggt

SEQ ID NO: 70139 - DNA, 15 bp, Artificial Sequence
  dgRNA
  Slc14a1
ctgcacagcgtctca

SEQ ID NO: 70140 - DNA, 15 bp, Artificial Sequence
  dgRNA
  Slc14a1
tctgcacagcgtctc

SEQ ID NO: 70141 - DNA, 15 bp, Artificial Sequence
  dgRNA
  Slc14a1
atgccgttggggtgg

SEQ ID NO: 70142 - DNA, 15 bp, Artificial Sequence
  dgRNA
  Asap2
gcagacacaatgcgg

SEQ ID NO: 70143 - DNA, 15 bp, Artificial Sequence
  dgRNA
  Asap2
gcggcctcagcttct

SEQ ID NO: 70144 - DNA, 15 bp, Artificial Sequence
  dgRNA
  Asap2
ttctcggcggcgcag

SEQ ID NO: 70145 - DNA, 15 bp, Artificial Sequence
  dgRNA
  Asap2
tcggcggcgcagtgg

SEQ ID NO: 70146 - DNA, 15 bp, Artificial Sequence
  dgRNA
  Spin1
tgtacctcgccgctc

SEQ ID NO: 70147 - DNA, 15 bp, Artificial Sequence
  dgRNA
  Spin1
gtacctcgccgctcc

SEQ ID NO: 70148 - DNA, 15 bp, Artificial Sequence
  dgRNA
  Spin1
cgcgccccaccctcc

SEQ ID NO: 70149 - DNA, 15 bp, Artificial Sequence
  dgRNA
  Spin1
cctgcgcagtgcgtc

SEQ ID NO: 70150 - DNA, 15 bp, Artificial Sequence
  dgRNA
  Gm128
catgagtggtctgca

SEQ ID NO: 70151 - DNA, 15 bp, Artificial Sequence
  dgRNA
  Gm128
atgagtggtctgcat

SEQ ID NO: 70152 - DNA, 15 bp, Artificial Sequence
  dgRNA
  Gm128
gagtggtctgcatgg

SEQ ID NO: 70153 - DNA, 15 bp, Artificial Sequence
  dgRNA
  Gm128
acactgccttcaagc

SEQ ID NO: 70154 - DNA, 15 bp, Artificial Sequence
  dgRNA
  Snrnp200
gcgcgtgtgtctcgt

SEQ ID NO: 70155 - DNA, 15 bp, Artificial Sequence
  dgRNA
  Snrnp200
tgtctcgtcggtcaa

SEQ ID NO: 70156 - DNA, 15 bp, Artificial Sequence
  dgRNA
  Snrnp200
atggaatccttgacc

SEQ ID NO: 70157 - DNA, 15 bp, Artificial Sequence
  dgRNA
  Snrnp200
gcagtggttagtaac

SEQ ID NO: 70158 - DNA, 15 bp, Artificial Sequence
  dgRNA
  Ptpn18
cagccgaagcacccg

SEQ ID NO: 70159 - DNA, 15 bp, Artificial Sequence
  dgRNA
  Ptpn18
cacccgaggcgccag

SEQ ID NO: 70160 - DNA, 15 bp, Artificial Sequence
  dgRNA
  Ptpn18
acccgaggcgccagt

SEQ ID NO: 70161 - DNA, 15 bp, Artificial Sequence
  dgRNA
  Ptpn18
cccgaggcgccagtg

SEQ ID NO: 70162 - DNA, 15 bp, Artificial Sequence
  dgRNA
  Hcn2
ctcccccgcaagcag

SEQ ID NO: 70163 - DNA, 15 bp, Artificial Sequence
  dgRNA
  Hcn2
tccctcgggctcggc

SEQ ID NO: 70164 - DNA, 15 bp, Artificial Sequence
  dgRNA
  Hcn2
aggctcggttcccca

SEQ ID NO: 70165 - DNA, 15 bp, Artificial Sequence
  dgRNA
  Hcn2
caggctcggttcccc

SEQ ID NO: 70166 - DNA, 15 bp, Artificial Sequence
  dgRNA
  Prss27
agaaggtctcttgga

SEQ ID NO: 70167 - DNA, 15 bp, Artificial Sequence
  dgRNA
  Prss27
tctgccaagttatgt

SEQ ID NO: 70168 - DNA, 15 bp, Artificial Sequence
  dgRNA
  Prss27
gttatgtaggaccta

SEQ ID NO: 70169 - DNA, 15 bp, Artificial Sequence
  dgRNA
  Prss27
gccgggtcatagagt

SEQ ID NO: 70170 - DNA, 15 bp, Artificial Sequence
  dgRNA
  4930513O06Rik
ccagattgagcacta

SEQ ID NO: 70171 - DNA, 15 bp, Artificial Sequence
  dgRNA
  4930513O06Rik
ccctagtgctcaatc

SEQ ID NO: 70172 - DNA, 15 bp, Artificial Sequence
  dgRNA
  Zfp937
gatatgcaaaaagac

SEQ ID NO: 70173 - DNA, 15 bp, Artificial Sequence
  dgRNA
  Zfp937
gcctggaattattcc

SEQ ID NO: 70174 - DNA, 15 bp, Artificial Sequence
  dgRNA
  Zfp937
tcccacccaagtccg

SEQ ID NO: 70175 - DNA, 15 bp, Artificial Sequence
  dgRNA
  Zfp937
gcctggaataattcc

SEQ ID NO: 70176 - DNA, 15 bp, Artificial Sequence
  dgRNA
  Strip1
tccggcttagttcca

SEQ ID NO: 70177 - DNA, 15 bp, Artificial Sequence
  dgRNA
  Strip1
ccggcttagttccac

SEQ ID NO: 70178 - DNA, 15 bp, Artificial Sequence
  dgRNA
  Strip1
cttagttccacggga

SEQ ID NO: 70179 - DNA, 15 bp, Artificial Sequence
  dgRNA
  Strip1
agttccacgggaagg

SEQ ID NO: 70180 - DNA, 15 bp, Artificial Sequence
  dgRNA
  Cyp2j8
ttcgttgcagaagac

SEQ ID NO: 70181 - DNA, 15 bp, Artificial Sequence
  dgRNA
  Cyp2j8
ggaggcagggctaat

SEQ ID NO: 70182 - DNA, 15 bp, Artificial Sequence
  dgRNA
  Cyp2j8
gaggcagggctaata

SEQ ID NO: 70183 - DNA, 15 bp, Artificial Sequence
  dgRNA
  Cyp2j8
agggctaatagggat

SEQ ID NO: 70184 - DNA, 15 bp, Artificial Sequence
  dgRNA
  Sun5
acatttagtaaaggc

SEQ ID NO: 70185 - DNA, 15 bp, Artificial Sequence
  dgRNA
  Sun5
catagagtacttgga

SEQ ID NO: 70186 - DNA, 15 bp, Artificial Sequence
  dgRNA
  Sun5
acctcatagagtact

SEQ ID NO: 70187 - DNA, 15 bp, Artificial Sequence
  dgRNA
  3110052M02Rik
catcagaatactatg

SEQ ID NO: 70188 - DNA, 15 bp, Artificial Sequence
  dgRNA
  3110052M02Rik
ggtcctttcatagaa

SEQ ID NO: 70189 - DNA, 15 bp, Artificial Sequence
  dgRNA
  Nedd4l
catttagggaccagt

SEQ ID NO: 70190 - DNA, 15 bp, Artificial Sequence
  dgRNA
  Nedd4l
atttagggaccagtc

SEQ ID NO: 70191 - DNA, 15 bp, Artificial Sequence
  dgRNA
  Nedd4l
tagggaccagtcggg

SEQ ID NO: 70192 - DNA, 15 bp, Artificial Sequence
  dgRNA
  Nedd4l
tgtcactcattgtaa

SEQ ID NO: 70193 - DNA, 15 bp, Artificial Sequence
  dgRNA
  Lrrc47
tgaccacctaacctg

SEQ ID NO: 70194 - DNA, 15 bp, Artificial Sequence
  dgRNA
  Lrrc47
gaccacctaacctgt

SEQ ID NO: 70195 - DNA, 15 bp, Artificial Sequence
  dgRNA
  Lrrc47
tgcgtccagactctc

SEQ ID NO: 70196 - DNA, 15 bp, Artificial Sequence
  dgRNA
  Lrrc47
atttccggctcccgc

SEQ ID NO: 70197 - DNA, 15 bp, Artificial Sequence
  dgRNA
  Kcnk6
tcgaactccaccctc

SEQ ID NO: 70198 - DNA, 15 bp, Artificial Sequence
  dgRNA
  Kcnk6
cctacaccaggtgtt

SEQ ID NO: 70199 - DNA, 15 bp, Artificial Sequence
  dgRNA
  Kcnk6
ctacaccaggtgttt

SEQ ID NO: 70200 - DNA, 15 bp, Artificial Sequence
  dgRNA
  Kcnk6
cagtttcccagcgtc

SEQ ID NO: 70201 - DNA, 15 bp, Artificial Sequence
  dgRNA
  Irf8
gaaggcggatttggc

SEQ ID NO: 70202 - DNA, 15 bp, Artificial Sequence
  dgRNA
  Irf8
gcaggctgcgctgat

SEQ ID NO: 70203 - DNA, 15 bp, Artificial Sequence
  dgRNA
  Irf8
caggctgcgctgatt

SEQ ID NO: 70204 - DNA, 15 bp, Artificial Sequence
  dgRNA
  Irf8
ccgtcgctctgcgcg

SEQ ID NO: 70205 - DNA, 15 bp, Artificial Sequence
  dgRNA
  Atp13a1
gggctcttccgtttc

SEQ ID NO: 70206 - DNA, 15 bp, Artificial Sequence
  dgRNA
  Atp13a1
ggctcttccgtttca

SEQ ID NO: 70207 - DNA, 15 bp, Artificial Sequence
  dgRNA
  Atp13a1
gttcttagttcgcca

SEQ ID NO: 70208 - DNA, 15 bp, Artificial Sequence
  dgRNA
  Atp13a1
cttagcaagctgatt

SEQ ID NO: 70209 - DNA, 15 bp, Artificial Sequence
  dgRNA
  Vwa5b2
ccgggaagtgagcga

SEQ ID NO: 70210 - DNA, 15 bp, Artificial Sequence
  dgRNA
  Thegl
agcatatgtgtaccg

SEQ ID NO: 70211 - DNA, 15 bp, Artificial Sequence
  dgRNA
  Thegl
gcatatgtgtaccgc

SEQ ID NO: 70212 - DNA, 15 bp, Artificial Sequence
  dgRNA
  Thegl
tatgtgtaccgcggg

SEQ ID NO: 70213 - DNA, 15 bp, Artificial Sequence
  dgRNA
  Thegl
ccttcacaccggaag

SEQ ID NO: 70214 - DNA, 15 bp, Artificial Sequence
  dgRNA
  Barhl1
aaaagaatcgggccg

SEQ ID NO: 70215 - DNA, 15 bp, Artificial Sequence
  dgRNA
  Barhl1
aaagaatcgggccgc

SEQ ID NO: 70216 - DNA, 15 bp, Artificial Sequence
  dgRNA
  Barhl1
catcacccccaaaat

SEQ ID NO: 70217 - DNA, 15 bp, Artificial Sequence
  dgRNA
  Barhl1
tcagcgtcatcactc

SEQ ID NO: 70218 - DNA, 15 bp, Artificial Sequence
  dgRNA
  Spag1
gctcgggtctcgggt

SEQ ID NO: 70219 - DNA, 15 bp, Artificial Sequence
  dgRNA
  Spag1
gtcggcatcctccgc

SEQ ID NO: 70220 - DNA, 15 bp, Artificial Sequence
  dgRNA
  Spag1
aggtgagcaccctcg

SEQ ID NO: 70221 - DNA, 15 bp, Artificial Sequence
  dgRNA
  Spag1
agcaccctcggggcg

SEQ ID NO: 70222 - DNA, 15 bp, Artificial Sequence
  dgRNA
  Chst7
gcgttgagcaaaccc

SEQ ID NO: 70223 - DNA, 15 bp, Artificial Sequence
  dgRNA
  Chst7
ggagcagagcgtaag

SEQ ID NO: 70224 - DNA, 15 bp, Artificial Sequence
  dgRNA
  Chst7
gagcagagcgtaagt

SEQ ID NO: 70225 - DNA, 15 bp, Artificial Sequence
  dgRNA
  Chst7
cagagcgtaagtggg

SEQ ID NO: 70226 - DNA, 15 bp, Artificial Sequence
  dgRNA
  Lipi
aagacatctacaatt

SEQ ID NO: 70227 - DNA, 15 bp, Artificial Sequence
  dgRNA
  Lipi
tacgaagtctttctt

SEQ ID NO: 70228 - DNA, 15 bp, Artificial Sequence
  dgRNA
  Lipi
cttaacacacgctag

SEQ ID NO: 70229 - DNA, 15 bp, Artificial Sequence
  dgRNA
  Lipi
caccttttccagccg

SEQ ID NO: 70230 - DNA, 15 bp, Artificial Sequence
  dgRNA
  Slc38a11
gtgcgccctgagtga

SEQ ID NO: 70231 - DNA, 15 bp, Artificial Sequence
  dgRNA
  Slc38a11
tgcgccctgagtgag

SEQ ID NO: 70232 - DNA, 15 bp, Artificial Sequence
  dgRNA
  Slc38a11
cccgcagcagcgagc

SEQ ID NO: 70233 - DNA, 15 bp, Artificial Sequence
  dgRNA
  Slc38a11
ccgcagcagcgagca

SEQ ID NO: 70234 - DNA, 15 bp, Artificial Sequence
  dgRNA
  Slc27a6
cctgttggacagccg

SEQ ID NO: 70235 - DNA, 15 bp, Artificial Sequence
  dgRNA
  Slc27a6
gttggacagccgtgg

SEQ ID NO: 70236 - DNA, 15 bp, Artificial Sequence
  dgRNA
  Slc27a6
ttggacagccgtgga

SEQ ID NO: 70237 - DNA, 15 bp, Artificial Sequence
  dgRNA
  Slc27a6
acagccgtggagggt

SEQ ID NO: 70238 - DNA, 15 bp, Artificial Sequence
  dgRNA
  Rgs9bp
atttgtagggcgcta

SEQ ID NO: 70239 - DNA, 15 bp, Artificial Sequence
  dgRNA
  Rgs9bp
agaattatcatggta

SEQ ID NO: 70240 - DNA, 15 bp, Artificial Sequence
  dgRNA
  Rgs9bp
cacacttgatctacc

SEQ ID NO: 70241 - DNA, 15 bp, Artificial Sequence
  dgRNA
  Rgs9bp
acacttgatctacct

SEQ ID NO: 70242 - DNA, 15 bp, Artificial Sequence
  dgRNA
  Pls1
gacgcccctgcagcg

SEQ ID NO: 70243 - DNA, 15 bp, Artificial Sequence
  dgRNA
  Pls1
acgcccctgcagcgc

SEQ ID NO: 70244 - DNA, 15 bp, Artificial Sequence
  dgRNA
  Pls1
ggatttcaagcgtgc

SEQ ID NO: 70245 - DNA, 15 bp, Artificial Sequence
  dgRNA
  Pls1
tttcaagcgtgcggg

SEQ ID NO: 70246 - DNA, 15 bp, Artificial Sequence
  dgRNA
  Ccdc144b
atccccttgcaacac

SEQ ID NO: 70247 - DNA, 15 bp, Artificial Sequence
  dgRNA
  Ccdc144b
tccccttgcaacaca

SEQ ID NO: 70248 - DNA, 15 bp, Artificial Sequence
  dgRNA
  Ccdc144b
accctgtgttgcaag

SEQ ID NO: 70249 - DNA, 15 bp, Artificial Sequence
  dgRNA
  Ccdc144b
caccctgtgttgcaa

SEQ ID NO: 70250 - DNA, 15 bp, Artificial Sequence
  dgRNA
  Zfp652
cttcgaaagaagacg

SEQ ID NO: 70251 - DNA, 15 bp, Artificial Sequence
  dgRNA
  Zfp652
ttcgaagagaactgc

SEQ ID NO: 70252 - DNA, 15 bp, Artificial Sequence
  dgRNA
  Extl3
ctccgcctgtgcctt

SEQ ID NO: 70253 - DNA, 15 bp, Artificial Sequence
  dgRNA
  Extl3
gccttcggacgcgtc

SEQ ID NO: 70254 - DNA, 15 bp, Artificial Sequence
  dgRNA
  Extl3
cgctttcctctcgct

SEQ ID NO: 70255 - DNA, 15 bp, Artificial Sequence
  dgRNA
  Extl3
tcgctcggcagacgc

SEQ ID NO: 70256 - DNA, 15 bp, Artificial Sequence
  dgRNA
  Rere
ccttccgcctcctat

SEQ ID NO: 70257 - DNA, 15 bp, Artificial Sequence
  dgRNA
  Rere
atggtcgatactgcg

SEQ ID NO: 70258 - DNA, 15 bp, Artificial Sequence
  dgRNA
  Rere
gtcgatactgcgagg

SEQ ID NO: 70259 - DNA, 15 bp, Artificial Sequence
  dgRNA
  Rere
tcgatactgcgaggt

SEQ ID NO: 70260 - DNA, 15 bp, Artificial Sequence
  dgRNA
  Fam229a
gctccgcttccaggc

SEQ ID NO: 70261 - DNA, 15 bp, Artificial Sequence
  dgRNA
  Fam229a
gccctcactaaatgc

SEQ ID NO: 70262 - DNA, 15 bp, Artificial Sequence
  dgRNA
  Fam229a
aatgccggaacgctc

SEQ ID NO: 70263 - DNA, 15 bp, Artificial Sequence
  dgRNA
  Fam229a
atgccggaacgctct

SEQ ID NO: 70264 - DNA, 15 bp, Artificial Sequence
  dgRNA
  Lemd3
ggagcgcggtcacgc

SEQ ID NO: 70265 - DNA, 15 bp, Artificial Sequence
  dgRNA
  Lemd3
gagcgcggtcacgcc

SEQ ID NO: 70266 - DNA, 15 bp, Artificial Sequence
  dgRNA
  Lemd3
gccgcgccgctcagg

SEQ ID NO: 70267 - DNA, 15 bp, Artificial Sequence
  dgRNA
  Lemd3
ggcgccttcccgctc

SEQ ID NO: 70268 - DNA, 15 bp, Artificial Sequence
  dgRNA
  Adamtsl5
cccctgccgcaggtc

SEQ ID NO: 70269 - DNA, 15 bp, Artificial Sequence
  dgRNA
  Adamtsl5
ccctgccgcaggtcc

SEQ ID NO: 70270 - DNA, 15 bp, Artificial Sequence
  dgRNA
  Adamtsl5
ctctcctgccgcacg

SEQ ID NO: 70271 - DNA, 15 bp, Artificial Sequence
  dgRNA
  Adamtsl5
tctcctgccgcacga

SEQ ID NO: 70272 - DNA, 15 bp, Artificial Sequence
  dgRNA
  Dhx15
tctcagagagacgcg

SEQ ID NO: 70273 - DNA, 15 bp, Artificial Sequence
  dgRNA
  Dhx15
ctcagagagacgcga

SEQ ID NO: 70274 - DNA, 15 bp, Artificial Sequence
  dgRNA
  Dhx15
tcagagagacgcgag

SEQ ID NO: 70275 - DNA, 15 bp, Artificial Sequence
  dgRNA
  Dhx15
agacgcgaggggaaa

SEQ ID NO: 70276 - DNA, 15 bp, Artificial Sequence
  dgRNA
  Fut9
taagagtctgcatat

SEQ ID NO: 70277 - DNA, 15 bp, Artificial Sequence
  dgRNA
  Fut9
tcggagacgcagcaa

SEQ ID NO: 70278 - DNA, 15 bp, Artificial Sequence
  dgRNA
  Fut9
cgcacacatagccac

SEQ ID NO: 70279 - DNA, 15 bp, Artificial Sequence
  dgRNA
  Mgme1
tcgctccgcgccacg

SEQ ID NO: 70280 - DNA, 15 bp, Artificial Sequence
  dgRNA
  Mgme1
cgcggacaccagcac

SEQ ID NO: 70281 - DNA, 15 bp, Artificial Sequence
  dgRNA
  Mgme1
gacaccagcaccgga

SEQ ID NO: 70282 - DNA, 15 bp, Artificial Sequence
  dgRNA
  Mgme1
ccggagggccgcgac

SEQ ID NO: 70283 - DNA, 15 bp, Artificial Sequence
  dgRNA
  Zfp617
caactgtgggagtcc

SEQ ID NO: 70284 - DNA, 15 bp, Artificial Sequence
  dgRNA
  Zfp617
acggtttagcgtcct

SEQ ID NO: 70285 - DNA, 15 bp, Artificial Sequence
  dgRNA
  Zfp617
atgacgccataccct

SEQ ID NO: 70286 - DNA, 15 bp, Artificial Sequence
  dgRNA
  Zfp617
gccataccctaggaa

SEQ ID NO: 70287 - DNA, 15 bp, Artificial Sequence
  dgRNA
  Wdr55
tagtgagctgtaact

SEQ ID NO: 70288 - DNA, 15 bp, Artificial Sequence
  dgRNA
  Wdr55
aattcgcatcagctg

SEQ ID NO: 70289 - DNA, 15 bp, Artificial Sequence
  dgRNA
  Wdr55
cgcatcagctgcggc

SEQ ID NO: 70290 - DNA, 15 bp, Artificial Sequence
  dgRNA
  Wdr55
gatcccgcctcctcc

SEQ ID NO: 70291 - DNA, 15 bp, Artificial Sequence
  dgRNA
  Gal3st3
gatgccaataccaac

SEQ ID NO: 70292 - DNA, 15 bp, Artificial Sequence
  dgRNA
  Gal3st3
ctcctctgagccgcc

SEQ ID NO: 70293 - DNA, 15 bp, Artificial Sequence
  dgRNA
  Gal3st3
gcccccggtgtgaga

SEQ ID NO: 70294 - DNA, 15 bp, Artificial Sequence
  dgRNA
  Gal3st3
cccccggtgtgagat

SEQ ID NO: 70295 - DNA, 15 bp, Artificial Sequence
  dgRNA
  Gnb2l1
cagcgctgccaaact

SEQ ID NO: 70296 - DNA, 15 bp, Artificial Sequence
  dgRNA
  Gnb2l1
ccaaactaggttgcg

SEQ ID NO: 70297 - DNA, 15 bp, Artificial Sequence
  dgRNA
  Gnb2l1
ctctccgagtatttc

SEQ ID NO: 70298 - DNA, 15 bp, Artificial Sequence
  dgRNA
  Gnb2l1
gagtatttccggttc

SEQ ID NO: 70299 - DNA, 15 bp, Artificial Sequence
  dgRNA
  Acot11
agacatagagtccgg

SEQ ID NO: 70300 - DNA, 15 bp, Artificial Sequence
  dgRNA
  Acot11
tccggtggtgccagt

SEQ ID NO: 70301 - DNA, 15 bp, Artificial Sequence
  dgRNA
  Acot11
cagtaggtgggcaac

SEQ ID NO: 70302 - DNA, 15 bp, Artificial Sequence
  dgRNA
  Acot11
ggccccacgtggttg

SEQ ID NO: 70303 - DNA, 15 bp, Artificial Sequence
  dgRNA
  Olfr1093
cttctcattacccta

SEQ ID NO: 70304 - DNA, 15 bp, Artificial Sequence
  dgRNA
  Olfr1093
tataggaacttcctg

SEQ ID NO: 70305 - DNA, 15 bp, Artificial Sequence
  dgRNA
  Olfr1093
cactataaggggtaa

SEQ ID NO: 70306 - DNA, 15 bp, Artificial Sequence
  dgRNA
  Olfr1093
agatttcactataag

SEQ ID NO: 70307 - DNA, 15 bp, Artificial Sequence
  dgRNA
  Nedd4
aagagccacgtttct

SEQ ID NO: 70308 - DNA, 15 bp, Artificial Sequence
  dgRNA
  Nedd4
cctccgggggctgcg

SEQ ID NO: 70309 - DNA, 15 bp, Artificial Sequence
  dgRNA
  Nedd4
ccgcgacgcgcgctc

SEQ ID NO: 70310 - DNA, 15 bp, Artificial Sequence
  dgRNA
  Nedd4
cgagctccttgtttc

SEQ ID NO: 70311 - DNA, 15 bp, Artificial Sequence
  dgRNA
  Cecr6
ccgcctctccggtcc

SEQ ID NO: 70312 - DNA, 15 bp, Artificial Sequence
  dgRNA
  Cecr6
tcccggcggtctgct

SEQ ID NO: 70313 - DNA, 15 bp, Artificial Sequence
  dgRNA
  Cecr6
ttcactcgcccagtc

SEQ ID NO: 70314 - DNA, 15 bp, Artificial Sequence
  dgRNA
  Cecr6
ccggccgctccagtc

SEQ ID NO: 70315 - DNA, 15 bp, Artificial Sequence
  dgRNA
  Gm4907
caattgtactattca

SEQ ID NO: 70316 - DNA, 15 bp, Artificial Sequence
  dgRNA
  Gm4907
tcaattgtactattc

SEQ ID NO: 70317 - DNA, 15 bp, Artificial Sequence
  dgRNA
  Erbb4
gagctgaacatagcc

SEQ ID NO: 70318 - DNA, 15 bp, Artificial Sequence
  dgRNA
  Erbb4
aacatagcccggttt

SEQ ID NO: 70319 - DNA, 15 bp, Artificial Sequence
  dgRNA
  Erbb4
acatagcccggtttt

SEQ ID NO: 70320 - DNA, 15 bp, Artificial Sequence
  dgRNA
  Erbb4
catagcccggttttg

SEQ ID NO: 70321 - DNA, 15 bp, Artificial Sequence
  dgRNA
  Prss8
agcacccactgcgaa

SEQ ID NO: 70322 - DNA, 15 bp, Artificial Sequence
  dgRNA
  Prss8
actgcgaaaggatcc

SEQ ID NO: 70323 - DNA, 15 bp, Artificial Sequence
  dgRNA
  Prss8
aaagcctgctttccg

SEQ ID NO: 70324 - DNA, 15 bp, Artificial Sequence
  dgRNA
  Prss8
gcctgctttccgagg

SEQ ID NO: 70325 - DNA, 15 bp, Artificial Sequence
  dgRNA
  Wisp3
tcgcagagtccctgt

SEQ ID NO: 70326 - DNA, 15 bp, Artificial Sequence
  dgRNA
  Wisp3
caccgtgcagaccca

SEQ ID NO: 70327 - DNA, 15 bp, Artificial Sequence
  dgRNA
  Wisp3
cgtcttccaggagtt

SEQ ID NO: 70328 - DNA, 15 bp, Artificial Sequence
  dgRNA
  Wisp3
ccgtcttccaggagt

SEQ ID NO: 70329 - DNA, 15 bp, Artificial Sequence
  dgRNA
  Epb41l1
agagtctcgtcttcg

SEQ ID NO: 70330 - DNA, 15 bp, Artificial Sequence
  dgRNA
  Epb41l1
tcccgctgctcgcct

SEQ ID NO: 70331 - DNA, 15 bp, Artificial Sequence
  dgRNA
  Epb41l1
tgcctaggctctggt

SEQ ID NO: 70332 - DNA, 15 bp, Artificial Sequence
  dgRNA
  Epb41l1
ggcgtctgtcccacg

SEQ ID NO: 70333 - DNA, 15 bp, Artificial Sequence
  dgRNA
  Saa2
tctggagtattacca

SEQ ID NO: 70334 - DNA, 15 bp, Artificial Sequence
  dgRNA
  Saa2
gagtattaccaaggg

SEQ ID NO: 70335 - DNA, 15 bp, Artificial Sequence
  dgRNA
  Saa2
accaagggtggtgcc

SEQ ID NO: 70336 - DNA, 15 bp, Artificial Sequence
  dgRNA
  Saa2
caattttctgtgcgg

SEQ ID NO: 70337 - DNA, 15 bp, Artificial Sequence
  dgRNA
  Prkcz
tgggccgcggccgcg

SEQ ID NO: 70338 - DNA, 15 bp, Artificial Sequence
  dgRNA
  Prkcz
ccgcgcggccccccg

SEQ ID NO: 70339 - DNA, 15 bp, Artificial Sequence
  dgRNA
  Prkcz
cggccccccgaggat

SEQ ID NO: 70340 - DNA, 15 bp, Artificial Sequence
  dgRNA
  Prkcz
cccgaggattggccc

SEQ ID NO: 70341 - DNA, 15 bp, Artificial Sequence
  dgRNA
  Rnf180
gctatgtctttggtc

SEQ ID NO: 70342 - DNA, 15 bp, Artificial Sequence
  dgRNA
  Rnf180
cggaactgctgctgt

SEQ ID NO: 70343 - DNA, 15 bp, Artificial Sequence
  dgRNA
  Rnf180
aagtatcttgtactg

SEQ ID NO: 70344 - DNA, 15 bp, Artificial Sequence
  dgRNA
  Scarb2
aagcggcagagcgaa

SEQ ID NO: 70345 - DNA, 15 bp, Artificial Sequence
  dgRNA
  Scarb2
agcggcagagcgaat

SEQ ID NO: 70346 - DNA, 15 bp, Artificial Sequence
  dgRNA
  Scarb2
gcggcagagcgaatg

SEQ ID NO: 70347 - DNA, 15 bp, Artificial Sequence
  dgRNA
  Scarb2
gcgatttcagttccc

SEQ ID NO: 70348 - DNA, 15 bp, Artificial Sequence
  dgRNA
  Pramef17
gctgcccataagggg

SEQ ID NO: 70349 - DNA, 15 bp, Artificial Sequence
  dgRNA
  Pramef17
cttatgggcagcatg

SEQ ID NO: 70350 - DNA, 15 bp, Artificial Sequence
  dgRNA
  Pramef17
gcaacctccccttat

SEQ ID NO: 70351 - DNA, 15 bp, Artificial Sequence
  dgRNA
  Pramef17
agcaacctcccctta

SEQ ID NO: 70352 - DNA, 15 bp, Artificial Sequence
  dgRNA
  Spag17
gccagctcgacccgc

SEQ ID NO: 70353 - DNA, 15 bp, Artificial Sequence
  dgRNA
  Spag17
tcaccagatataccc

SEQ ID NO: 70354 - DNA, 15 bp, Artificial Sequence
  dgRNA
  Spag17
ataccctggtatttc

SEQ ID NO: 70355 - DNA, 15 bp, Artificial Sequence
  dgRNA
  Spag17
gccactctgctacta

SEQ ID NO: 70356 - DNA, 15 bp, Artificial Sequence
  dgRNA
  Dyrk3
agcggtctgctgagc

SEQ ID NO: 70357 - DNA, 15 bp, Artificial Sequence
  dgRNA
  Dyrk3
tgatactcccatgtt

SEQ ID NO: 70358 - DNA, 15 bp, Artificial Sequence
  dgRNA
  Dyrk3
tttggtttcacggct

SEQ ID NO: 70359 - DNA, 15 bp, Artificial Sequence
  dgRNA
  Dyrk3
aatacgaagaagcgt

SEQ ID NO: 70360 - DNA, 15 bp, Artificial Sequence
  dgRNA
  Slc16a2
aggtaggcgagtaag

SEQ ID NO: 70361 - DNA, 15 bp, Artificial Sequence
  dgRNA
  Slc16a2
taggcgagtaagagg

SEQ ID NO: 70362 - DNA, 15 bp, Artificial Sequence
  dgRNA
  Slc16a2
agagcgaggttgtag

SEQ ID NO: 70363 - DNA, 15 bp, Artificial Sequence
  dgRNA
  Slc16a2
agcggctgcctgttg

SEQ ID NO: 70364 - DNA, 15 bp, Artificial Sequence
  dgRNA
  Eci1
tgccctaactggcac

SEQ ID NO: 70365 - DNA, 15 bp, Artificial Sequence
  dgRNA
  Eci1
ccctaactggcacag

SEQ ID NO: 70366 - DNA, 15 bp, Artificial Sequence
  dgRNA
  Eci1
ctggacgctgcggac

SEQ ID NO: 70367 - DNA, 15 bp, Artificial Sequence
  dgRNA
  Eci1
cggactggctaacct

SEQ ID NO: 70368 - DNA, 15 bp, Artificial Sequence
  dgRNA
  Vmn2r59
cctactctgcatcat

SEQ ID NO: 70369 - DNA, 15 bp, Artificial Sequence
  dgRNA
  Vmn2r59
ccaatgatgcagagt

SEQ ID NO: 70370 - DNA, 15 bp, Artificial Sequence
  dgRNA
  Lzts2
cccccgcgtgcgccc

SEQ ID NO: 70371 - DNA, 15 bp, Artificial Sequence
  dgRNA
  Lzts2
cgcgtgcgccctggc

SEQ ID NO: 70372 - DNA, 15 bp, Artificial Sequence
  dgRNA
  Lzts2
ctggcacgcgtgacg

SEQ ID NO: 70373 - DNA, 15 bp, Artificial Sequence
  dgRNA
  Lzts2
tggcacgcgtgacgt

SEQ ID NO: 70374 - DNA, 15 bp, Artificial Sequence
  dgRNA
  Zcchc11
gattcaagaaatgcg

SEQ ID NO: 70375 - DNA, 15 bp, Artificial Sequence
  dgRNA
  Zcchc11
attcaagaaatgcgt

SEQ ID NO: 70376 - DNA, 15 bp, Artificial Sequence
  dgRNA
  Zcchc11
aaatgcgtgggctgt

SEQ ID NO: 70377 - DNA, 15 bp, Artificial Sequence
  dgRNA
  Zcchc11
gagcctgcacatcta

SEQ ID NO: 70378 - DNA, 15 bp, Artificial Sequence
  dgRNA
  Cep164
gcttcctttcgtccg

SEQ ID NO: 70379 - DNA, 15 bp, Artificial Sequence
  dgRNA
  Cep164
cttcctttcgtccgc

SEQ ID NO: 70380 - DNA, 15 bp, Artificial Sequence
  dgRNA
  Cep164
acgggcaaagcctcg

SEQ ID NO: 70381 - DNA, 15 bp, Artificial Sequence
  dgRNA
  Cep164
cgggcaaagcctcgt

SEQ ID NO: 70382 - DNA, 15 bp, Artificial Sequence
  dgRNA
  Fmo3
ggagcttatcttaaa

SEQ ID NO: 70383 - DNA, 15 bp, Artificial Sequence
  dgRNA
  Fmo3
aggagcttatcttaa

SEQ ID NO: 70384 - DNA, 15 bp, Artificial Sequence
  dgRNA
  Fmo3
gagagtcattggaac

SEQ ID NO: 70385 - DNA, 15 bp, Artificial Sequence
  dgRNA
  Scand1
caccctcctttaccc

SEQ ID NO: 70386 - DNA, 15 bp, Artificial Sequence
  dgRNA
  Scand1
cctgcctggtcaagt

SEQ ID NO: 70387 - DNA, 15 bp, Artificial Sequence
  dgRNA
  Scand1
agcatctaccctagg

SEQ ID NO: 70388 - DNA, 15 bp, Artificial Sequence
  dgRNA
  Scand1
taccctaggaggcgc

SEQ ID NO: 70389 - DNA, 15 bp, Artificial Sequence
  dgRNA
  Kcnj13
ccacgtcagttctag

SEQ ID NO: 70390 - DNA, 15 bp, Artificial Sequence
  dgRNA
  Kcnj13
atgatcagagctaat

SEQ ID NO: 70391 - DNA, 15 bp, Artificial Sequence
  dgRNA
  Kcnj13
actgacgtggagaag

SEQ ID NO: 70392 - DNA, 15 bp, Artificial Sequence
  dgRNA
  Kcnj13
aactgacgtggagaa

SEQ ID NO: 70393 - DNA, 15 bp, Artificial Sequence
  dgRNA
  Sema6a
ggagacgccagccca

SEQ ID NO: 70394 - DNA, 15 bp, Artificial Sequence
  dgRNA
  Sema6a
gacgccagcccaggg

SEQ ID NO: 70395 - DNA, 15 bp, Artificial Sequence
  dgRNA
  Sema6a
aggcggggttgctgg

SEQ ID NO: 70396 - DNA, 15 bp, Artificial Sequence
  dgRNA
  Sema6a
ctgcgcaatccagtc

SEQ ID NO: 70397 - DNA, 15 bp, Artificial Sequence
  dgRNA
  Chpt1
cccgcgagctcgctg

SEQ ID NO: 70398 - DNA, 15 bp, Artificial Sequence
  dgRNA
  Chpt1
cacccccccgtggcc

SEQ ID NO: 70399 - DNA, 15 bp, Artificial Sequence
  dgRNA
  Chpt1
cggtggcgaggctgg

SEQ ID NO: 70400 - DNA, 15 bp, Artificial Sequence
  dgRNA
  Chpt1
ggcggtggcgaggct

SEQ ID NO: 70401 - DNA, 15 bp, Artificial Sequence
  dgRNA
  Zfp583
gattgtgacaatata

SEQ ID NO: 70402 - DNA, 15 bp, Artificial Sequence
  dgRNA
  Zfp583
atataagggatcatg

SEQ ID NO: 70403 - DNA, 15 bp, Artificial Sequence
  dgRNA
  Zfp583
accccacaccgtgtg

SEQ ID NO: 70404 - DNA, 15 bp, Artificial Sequence
  dgRNA
  Zfp583
ccccacaccgtgtga

SEQ ID NO: 70405 - DNA, 15 bp, Artificial Sequence
  dgRNA
  Znrf4
atgaggcgaatgacc

SEQ ID NO: 70406 - DNA, 15 bp, Artificial Sequence
  dgRNA
  Znrf4
tgaggcgaatgacct

SEQ ID NO: 70407 - DNA, 15 bp, Artificial Sequence
  dgRNA
  Znrf4
gaatgacctaagtca

SEQ ID NO: 70408 - DNA, 15 bp, Artificial Sequence
  dgRNA
  Znrf4
gtctgcaacagccaa

SEQ ID NO: 70409 - DNA, 15 bp, Artificial Sequence
  dgRNA
  Prpsap1
gaacacgcgagtcag

SEQ ID NO: 70410 - DNA, 15 bp, Artificial Sequence
  dgRNA
  Prpsap1
cgcctgtgtcagaac

SEQ ID NO: 70411 - DNA, 15 bp, Artificial Sequence
  dgRNA
  Prpsap1
tgcccttttccgaga

SEQ ID NO: 70412 - DNA, 15 bp, Artificial Sequence
  dgRNA
  Prpsap1
ccttttccgagatgg

SEQ ID NO: 70413 - DNA, 15 bp, Artificial Sequence
  dgRNA
  Btbd10
ctcgcggggaagcta

SEQ ID NO: 70414 - DNA, 15 bp, Artificial Sequence
  dgRNA
  Btbd10
tcgcggggaagctac

SEQ ID NO: 70415 - DNA, 15 bp, Artificial Sequence
  dgRNA
  Btbd10
tgccaaccgagaccg

SEQ ID NO: 70416 - DNA, 15 bp, Artificial Sequence
  dgRNA
  Btbd10
gcggagacactactc

SEQ ID NO: 70417 - DNA, 15 bp, Artificial Sequence
  dgRNA
  Adm
tagaagcaagcacgc

SEQ ID NO: 70418 - DNA, 15 bp, Artificial Sequence
  dgRNA
  Adm
gcaagcacgctggag

SEQ ID NO: 70419 - DNA, 15 bp, Artificial Sequence
  dgRNA
  Adm
caagcacgctggaga

SEQ ID NO: 70420 - DNA, 15 bp, Artificial Sequence
  dgRNA
  Adm
gcgcttataagacgc

SEQ ID NO: 70421 - DNA, 15 bp, Artificial Sequence
  dgRNA
  Atcay
tttcgcctcagccaa

SEQ ID NO: 70422 - DNA, 15 bp, Artificial Sequence
  dgRNA
  Atcay
ttcgcctcagccaat

SEQ ID NO: 70423 - DNA, 15 bp, Artificial Sequence
  dgRNA
  Atcay
tcgcctcagccaatg

SEQ ID NO: 70424 - DNA, 15 bp, Artificial Sequence
  dgRNA
  Atcay
ctagaactgtctatc

SEQ ID NO: 70425 - DNA, 15 bp, Artificial Sequence
  dgRNA
  Cyp2c55
cagactagctcacca

SEQ ID NO: 70426 - DNA, 15 bp, Artificial Sequence
  dgRNA
  Cyp2c55
ctagctcaccatggt

SEQ ID NO: 70427 - DNA, 15 bp, Artificial Sequence
  dgRNA
  Cyp2c55
gtaaaatctcctccc

SEQ ID NO: 70428 - DNA, 15 bp, Artificial Sequence
  dgRNA
  Cyp2c55
ctgcacataactgat

SEQ ID NO: 70429 - DNA, 15 bp, Artificial Sequence
  dgRNA
  Phf5a
tttggtgcacctgca

SEQ ID NO: 70430 - DNA, 15 bp, Artificial Sequence
  dgRNA
  Phf5a
tgcaaggacctagcg

SEQ ID NO: 70431 - DNA, 15 bp, Artificial Sequence
  dgRNA
  Phf5a
ctcgcgagatctagc

SEQ ID NO: 70432 - DNA, 15 bp, Artificial Sequence
  dgRNA
  Phf5a
agatctagccggttt

SEQ ID NO: 70433 - DNA, 15 bp, Artificial Sequence
  dgRNA
  Ank1
gttctcgccctgtct

SEQ ID NO: 70434 - DNA, 15 bp, Artificial Sequence
  dgRNA
  Gm13547
ggttgcctaatgtgg

SEQ ID NO: 70435 - DNA, 15 bp, Artificial Sequence
  dgRNA
  Gm13547
ttcctttaacgtgat

SEQ ID NO: 70436 - DNA, 15 bp, Artificial Sequence
  dgRNA
  Gm13547
tttaacgtgataggc

SEQ ID NO: 70437 - DNA, 15 bp, Artificial Sequence
  dgRNA
  Gm13547
ggtcttgttcaatcc

SEQ ID NO: 70438 - DNA, 15 bp, Artificial Sequence
  dgRNA
  Zic5
ccctcgctttacccc

SEQ ID NO: 70439 - DNA, 15 bp, Artificial Sequence
  dgRNA
  Zic5
tcgctttacccctgg

SEQ ID NO: 70440 - DNA, 15 bp, Artificial Sequence
  dgRNA
  Zic5
cgctttacccctggt

SEQ ID NO: 70441 - DNA, 15 bp, Artificial Sequence
  dgRNA
  Zic5
gctttacccctggtg

SEQ ID NO: 70442 - DNA, 15 bp, Artificial Sequence
  dgRNA
  Rmnd5b
ctagtttactgtggt

SEQ ID NO: 70443 - DNA, 15 bp, Artificial Sequence
  dgRNA
  Rmnd5b
tagtttactgtggtt

SEQ ID NO: 70444 - DNA, 15 bp, Artificial Sequence
  dgRNA
  Rmnd5b
ttgggggcccggatt

SEQ ID NO: 70445 - DNA, 15 bp, Artificial Sequence
  dgRNA
  Rmnd5b
gggcccggattaggc

SEQ ID NO: 70446 - DNA, 15 bp, Artificial Sequence
  dgRNA
  Amtn
tcagatcgtagacat

SEQ ID NO: 70447 - DNA, 15 bp, Artificial Sequence
  dgRNA
  Amtn
cagatcgtagacatt

SEQ ID NO: 70448 - DNA, 15 bp, Artificial Sequence
  dgRNA
  Amtn
ctcctaatgaagtgt

SEQ ID NO: 70449 - DNA, 15 bp, Artificial Sequence
  dgRNA
  Amtn
tcctaatgaagtgtt

SEQ ID NO: 70450 - DNA, 15 bp, Artificial Sequence
  dgRNA
  Olfr1141
ataaggttctacttt

SEQ ID NO: 70451 - DNA, 15 bp, Artificial Sequence
  dgRNA
  Olfr1141
catctaaaactagtg

SEQ ID NO: 70452 - DNA, 15 bp, Artificial Sequence
  dgRNA
  Lif
tgccacgcagcccag

SEQ ID NO: 70453 - DNA, 15 bp, Artificial Sequence
  dgRNA
  Lif
aggggcatcaagtac

SEQ ID NO: 70454 - DNA, 15 bp, Artificial Sequence
  dgRNA
  Lif
tcccaccaccgtgtc

SEQ ID NO: 70455 - DNA, 15 bp, Artificial Sequence
  dgRNA
  Lif
aaaggtgttgttaga

SEQ ID NO: 70456 - DNA, 15 bp, Artificial Sequence
  dgRNA
  Rbm48
ctttaaccgagttaa

SEQ ID NO: 70457 - DNA, 15 bp, Artificial Sequence
  dgRNA
  Rbm48
ttaaccgagttaaag

SEQ ID NO: 70458 - DNA, 15 bp, Artificial Sequence
  dgRNA
  Rbm48
gcactaggaattcca

SEQ ID NO: 70459 - DNA, 15 bp, Artificial Sequence
  dgRNA
  Rbm48
taggaattccacggt

SEQ ID NO: 70460 - DNA, 15 bp, Artificial Sequence
  dgRNA
  Gnao1
gagcgatgcgagttc

SEQ ID NO: 70461 - DNA, 15 bp, Artificial Sequence
  dgRNA
  Gnao1
agcgatgcgagttct

SEQ ID NO: 70462 - DNA, 15 bp, Artificial Sequence
  dgRNA
  Gnao1
gcgagttctgggccc

SEQ ID NO: 70463 - DNA, 15 bp, Artificial Sequence
  dgRNA
  Gnao1
gccctgccccgcgcg

SEQ ID NO: 70464 - DNA, 15 bp, Artificial Sequence
  dgRNA
  Fmo5
gtcgctctccctatg

SEQ ID NO: 70465 - DNA, 15 bp, Artificial Sequence
  dgRNA
  Fmo5
tcgctctccctatgc

SEQ ID NO: 70466 - DNA, 15 bp, Artificial Sequence
  dgRNA
  Fmo5
tgcgtttacggaaga

SEQ ID NO: 70467 - DNA, 15 bp, Artificial Sequence
  dgRNA
  Fmo5
gcgtttacggaagaa

SEQ ID NO: 70468 - DNA, 15 bp, Artificial Sequence
  dgRNA
  Bcl11a
cgcgtctggcgcctg

SEQ ID NO: 70469 - DNA, 15 bp, Artificial Sequence
  dgRNA
  Bcl11a
cggcccctgggggga

SEQ ID NO: 70470 - DNA, 15 bp, Artificial Sequence
  dgRNA
  Bcl11a
gacgcggcccctggg

SEQ ID NO: 70471 - DNA, 15 bp, Artificial Sequence
  dgRNA
  Bcl11a
agacgcggcccctgg

SEQ ID NO: 70472 - DNA, 15 bp, Artificial Sequence
  dgRNA
  Prr14l
taagagtcaacgcgg

SEQ ID NO: 70473 - DNA, 15 bp, Artificial Sequence
  dgRNA
  Prr14l
aagagtcaacgcggt

SEQ ID NO: 70474 - DNA, 15 bp, Artificial Sequence
  dgRNA
  Prr14l
agagtcaacgcggtg

SEQ ID NO: 70475 - DNA, 15 bp, Artificial Sequence
  dgRNA
  Prr14l
gagtcaacgcggtgg

SEQ ID NO: 70476 - DNA, 15 bp, Artificial Sequence
  dgRNA
  Lrrc8a
acttccgccccgaag

SEQ ID NO: 70477 - DNA, 15 bp, Artificial Sequence
  dgRNA
  Lrrc8a
cgccccgaagtggct

SEQ ID NO: 70478 - DNA, 15 bp, Artificial Sequence
  dgRNA
  Lrrc8a
gaagtggcttggcgc

SEQ ID NO: 70479 - DNA, 15 bp, Artificial Sequence
  dgRNA
  Lrrc8a
cttggcgcaggcacg

SEQ ID NO: 70480 - DNA, 15 bp, Artificial Sequence
  dgRNA
  Scd3
gactgtcttgcctcc

SEQ ID NO: 70481 - DNA, 15 bp, Artificial Sequence
  dgRNA
  Scd3
caccttgtcccatac

SEQ ID NO: 70482 - DNA, 15 bp, Artificial Sequence
  dgRNA
  Scd3
ggttcagtcaagtgt

SEQ ID NO: 70483 - DNA, 15 bp, Artificial Sequence
  dgRNA
  Scd3
aaaggtggttggcct

SEQ ID NO: 70484 - DNA, 15 bp, Artificial Sequence
  dgRNA
  Lrpprc
acagaaggcggatcc

SEQ ID NO: 70485 - DNA, 15 bp, Artificial Sequence
  dgRNA
  Lrpprc
cagaaggcggatcca

SEQ ID NO: 70486 - DNA, 15 bp, Artificial Sequence
  dgRNA
  Lrpprc
ggtatcccgcgaact

SEQ ID NO: 70487 - DNA, 15 bp, Artificial Sequence
  dgRNA
  Lrpprc
ctctcccgtgagcct

SEQ ID NO: 70488 - DNA, 15 bp, Artificial Sequence
  dgRNA
  Dnah2
tcggtttccacccat

SEQ ID NO: 70489 - DNA, 15 bp, Artificial Sequence
  dgRNA
  Dnah2
ggcccgagttctctt

SEQ ID NO: 70490 - DNA, 15 bp, Artificial Sequence
  dgRNA
  Dnah2
gctacaaatcacctg

SEQ ID NO: 70491 - DNA, 15 bp, Artificial Sequence
  dgRNA
  Dnah2
ctacaaatcacctgt

SEQ ID NO: 70492 - DNA, 15 bp, Artificial Sequence
  dgRNA
  Rcl1
ttcactaccggccaa

SEQ ID NO: 70493 - DNA, 15 bp, Artificial Sequence
  dgRNA
  Rcl1
cggccaatggcaacg

SEQ ID NO: 70494 - DNA, 15 bp, Artificial Sequence
  dgRNA
  Rcl1
tacagcgcagaccaa

SEQ ID NO: 70495 - DNA, 15 bp, Artificial Sequence
  dgRNA
  Rcl1
aatggcgacgcagag

SEQ ID NO: 70496 - DNA, 15 bp, Artificial Sequence
  dgRNA
  Nt5c1b
agccagcgaagtgat

SEQ ID NO: 70497 - DNA, 15 bp, Artificial Sequence
  dgRNA
  Nt5c1b
cgaagtgataggaaa

SEQ ID NO: 70498 - DNA, 15 bp, Artificial Sequence
  dgRNA
  Nt5c1b
ttcctatcacttcgc

SEQ ID NO: 70499 - DNA, 15 bp, Artificial Sequence
  dgRNA
  Nt5c1b
cgtttgttgttatga

SEQ ID NO: 70500 - DNA, 15 bp, Artificial Sequence
  dgRNA
  Tle2
tgggttgtacaaccc

SEQ ID NO: 70501 - DNA, 15 bp, Artificial Sequence
  dgRNA
  Tle2
caaccccggacgcgc

SEQ ID NO: 70502 - DNA, 15 bp, Artificial Sequence
  dgRNA
  Tle2
cccggacgcgctggc

SEQ ID NO: 70503 - DNA, 15 bp, Artificial Sequence
  dgRNA
  Tle2
ggacgcgctggctgg

SEQ ID NO: 70504 - DNA, 15 bp, Artificial Sequence
  dgRNA
  Il23r
tcactttcagtaatc

SEQ ID NO: 70505 - DNA, 15 bp, Artificial Sequence
  dgRNA
  Amigo3
ccgccccttaacagc

SEQ ID NO: 70506 - DNA, 15 bp, Artificial Sequence
  dgRNA
  Amigo3
gtccccgcccctgag

SEQ ID NO: 70507 - DNA, 15 bp, Artificial Sequence
  dgRNA
  Amigo3
cctgctgttaagggg

SEQ ID NO: 70508 - DNA, 15 bp, Artificial Sequence
  dgRNA
  Amigo3
gacctaagttcccat

SEQ ID NO: 70509 - DNA, 15 bp, Artificial Sequence
  dgRNA
  Uvssa
ctcgcgcctgcgctg

SEQ ID NO: 70510 - DNA, 15 bp, Artificial Sequence
  dgRNA
  Uvssa
ctgtggagccgctcc

SEQ ID NO: 70511 - DNA, 15 bp, Artificial Sequence
  dgRNA
  Uvssa
ggcaaatgacggaga

SEQ ID NO: 70512 - DNA, 15 bp, Artificial Sequence
  dgRNA
  Uvssa
gcaaatgacggagac

SEQ ID NO: 70513 - DNA, 15 bp, Artificial Sequence
  dgRNA
  Olfr609
aaggtgtcattaatt

SEQ ID NO: 70514 - DNA, 15 bp, Artificial Sequence
  dgRNA
  Olfr609
tgataaagtagatca

SEQ ID NO: 70515 - DNA, 15 bp, Artificial Sequence
  dgRNA
  Olfr609
gacactctctaggct

SEQ ID NO: 70516 - DNA, 15 bp, Artificial Sequence
  dgRNA
  Olfr609
ctgtacagttgatct

SEQ ID NO: 70517 - DNA, 15 bp, Artificial Sequence
  dgRNA
  Hnrnpm
gggagacttcgtgac

SEQ ID NO: 70518 - DNA, 15 bp, Artificial Sequence
  dgRNA
  Hnrnpm
ttgagtttccagtca

SEQ ID NO: 70519 - DNA, 15 bp, Artificial Sequence
  dgRNA
  Syk
acttcccagcgcggc

SEQ ID NO: 70520 - DNA, 15 bp, Artificial Sequence
  dgRNA
  Syk
ccagcgcggctggcc

SEQ ID NO: 70521 - DNA, 15 bp, Artificial Sequence
  dgRNA
  Syk
ggcccggctccgttc

SEQ ID NO: 70522 - DNA, 15 bp, Artificial Sequence
  dgRNA
  Syk
gcccggctccgttct

SEQ ID NO: 70523 - DNA, 15 bp, Artificial Sequence
  dgRNA
  Mbnl1
aagataccttctgcc

SEQ ID NO: 70524 - DNA, 15 bp, Artificial Sequence
  dgRNA
  Mbnl1
cgcaaatcagctgtg

SEQ ID NO: 70525 - DNA, 15 bp, Artificial Sequence
  dgRNA
  Mbnl1
cggtattgattagtt

SEQ ID NO: 70526 - DNA, 15 bp, Artificial Sequence
  dgRNA
  Mbnl1
gtttggtggtgcaat

SEQ ID NO: 70527 - DNA, 15 bp, Artificial Sequence
  dgRNA
  Tex16
gacttgaccaagact

SEQ ID NO: 70528 - DNA, 15 bp, Artificial Sequence
  dgRNA
  Tex16
ttgaacagtaccaga

SEQ ID NO: 70529 - DNA, 15 bp, Artificial Sequence
  dgRNA
  Tex16
gtaccagatggaatc

SEQ ID NO: 70530 - DNA, 15 bp, Artificial Sequence
  dgRNA
  Tex16
ggagctctgaaacat

SEQ ID NO: 70531 - DNA, 15 bp, Artificial Sequence
  dgRNA
  Gjc2
tgcctggacttcaag

SEQ ID NO: 70532 - DNA, 15 bp, Artificial Sequence
  dgRNA
  Gjc2
cttcaagtggaggct

SEQ ID NO: 70533 - DNA, 15 bp, Artificial Sequence
  dgRNA
  Gjc2
atggattcagaccct

SEQ ID NO: 70534 - DNA, 15 bp, Artificial Sequence
  dgRNA
  Gjc2
gattcagaccctagg

SEQ ID NO: 70535 - DNA, 15 bp, Artificial Sequence
  dgRNA
  Magee2
cctttcagtcagtag

SEQ ID NO: 70536 - DNA, 15 bp, Artificial Sequence
  dgRNA
  Magee2
ctttcagtcagtagt

SEQ ID NO: 70537 - DNA, 15 bp, Artificial Sequence
  dgRNA
  Magee2
ttaagcaccttggta

SEQ ID NO: 70538 - DNA, 15 bp, Artificial Sequence
  dgRNA
  Magee2
aggtattaagcacct

SEQ ID NO: 70539 - DNA, 15 bp, Artificial Sequence
  dgRNA
  Xpo7
tcccttgcgcttcca

SEQ ID NO: 70540 - DNA, 15 bp, Artificial Sequence
  dgRNA
  Xpo7
cccacccggcgtctc

SEQ ID NO: 70541 - DNA, 15 bp, Artificial Sequence
  dgRNA
  Xpo7
ccacccggcgtctcc

SEQ ID NO: 70542 - DNA, 15 bp, Artificial Sequence
  dgRNA
  Xpo7
ccaacccagagcggc

SEQ ID NO: 70543 - DNA, 15 bp, Artificial Sequence
  dgRNA
  Prokr1
agttccactcgactt

SEQ ID NO: 70544 - DNA, 15 bp, Artificial Sequence
  dgRNA
  Prokr1
gttccactcgactta

SEQ ID NO: 70545 - DNA, 15 bp, Artificial Sequence
  dgRNA
  Prokr1
gagatcactgaatat

SEQ ID NO: 70546 - DNA, 15 bp, Artificial Sequence
  dgRNA
  Prokr1
tcactgaatatgggc

SEQ ID NO: 70547 - DNA, 15 bp, Artificial Sequence
  dgRNA
  Psmc3
attccaagtttacct

SEQ ID NO: 70548 - DNA, 15 bp, Artificial Sequence
  dgRNA
  Psmc3
gttcttagattgcac

SEQ ID NO: 70549 - DNA, 15 bp, Artificial Sequence
  dgRNA
  Psmc3
tttcagttatccgcc

SEQ ID NO: 70550 - DNA, 15 bp, Artificial Sequence
  dgRNA
  Psmc3
tcccgaaagactccg

SEQ ID NO: 70551 - DNA, 15 bp, Artificial Sequence
  dgRNA
  Acer2
gtgcgggacagcctc

SEQ ID NO: 70552 - DNA, 15 bp, Artificial Sequence
  dgRNA
  Acer2
tggctttatgcggtg

SEQ ID NO: 70553 - DNA, 15 bp, Artificial Sequence
  dgRNA
  Rimkla
actcgcacttttctc

SEQ ID NO: 70554 - DNA, 15 bp, Artificial Sequence
  dgRNA
  Rimkla
ctcgcacttttctct

SEQ ID NO: 70555 - DNA, 15 bp, Artificial Sequence
  dgRNA
  Rimkla
tcgcacttttctctg

SEQ ID NO: 70556 - DNA, 15 bp, Artificial Sequence
  dgRNA
  Rimkla
cgcacttttctctgg

SEQ ID NO: 70557 - DNA, 15 bp, Artificial Sequence
  dgRNA
  Olfr584
taatcatccatgcct

SEQ ID NO: 70558 - DNA, 15 bp, Artificial Sequence
  dgRNA
  Olfr584
gtaacttcaccacaa

SEQ ID NO: 70559 - DNA, 15 bp, Artificial Sequence
  dgRNA
  Olfr584
acatgtcaggattgg

SEQ ID NO: 70560 - DNA, 15 bp, Artificial Sequence
  dgRNA
  Olfr584
atattagaacatgtc

SEQ ID NO: 70561 - DNA, 15 bp, Artificial Sequence
  dgRNA
  Gpc1
acggagcacatcgcc

SEQ ID NO: 70562 - DNA, 15 bp, Artificial Sequence
  dgRNA
  Gpc1
cggagcacatcgcct

SEQ ID NO: 70563 - DNA, 15 bp, Artificial Sequence
  dgRNA
  Gpc1
ccctccggagagcga

SEQ ID NO: 70564 - DNA, 15 bp, Artificial Sequence
  dgRNA
  Gpc1
cctccggagagcgaa

SEQ ID NO: 70565 - DNA, 15 bp, Artificial Sequence
  dgRNA
  Prkd3
ggcctatttcttaga

SEQ ID NO: 70566 - DNA, 15 bp, Artificial Sequence
  dgRNA
  Zhx3
gctgcgcatgcgctc

SEQ ID NO: 70567 - DNA, 15 bp, Artificial Sequence
  dgRNA
  Zhx3
ctgcgcatgcgctct

SEQ ID NO: 70568 - DNA, 15 bp, Artificial Sequence
  dgRNA
  Zhx3
catgcgctctgggta

SEQ ID NO: 70569 - DNA, 15 bp, Artificial Sequence
  dgRNA
  Zhx3
ctccccgcgacgtca

SEQ ID NO: 70570 - DNA, 15 bp, Artificial Sequence
  dgRNA
  Slc5a5
aacaagccctagatg

SEQ ID NO: 70571 - DNA, 15 bp, Artificial Sequence
  dgRNA
  Slc5a5
acaagccctagatgt

SEQ ID NO: 70572 - DNA, 15 bp, Artificial Sequence
  dgRNA
  Slc5a5
tgcccgcacccctga

SEQ ID NO: 70573 - DNA, 15 bp, Artificial Sequence
  dgRNA
  Slc5a5
aggcccgctcgcccc

SEQ ID NO: 70574 - DNA, 15 bp, Artificial Sequence
  dgRNA
  Bcl2l14
gggctcccatacagc

SEQ ID NO: 70575 - DNA, 15 bp, Artificial Sequence
  dgRNA
  Bcl2l14
aacacagggtttccg

SEQ ID NO: 70576 - DNA, 15 bp, Artificial Sequence
  dgRNA
  Bcl2l14
gttcggcagaacaca

SEQ ID NO: 70577 - DNA, 15 bp, Artificial Sequence
  dgRNA
  Bcl2l14
agttcggcagaacac

SEQ ID NO: 70578 - DNA, 15 bp, Artificial Sequence
  dgRNA
  Armc9
cggttgcccgggtga

SEQ ID NO: 70579 - DNA, 15 bp, Artificial Sequence
  dgRNA
  Armc9
tgcccgggtgacggc

SEQ ID NO: 70580 - DNA, 15 bp, Artificial Sequence
  dgRNA
  Armc9
cgccggccgtcaccc

SEQ ID NO: 70581 - DNA, 15 bp, Artificial Sequence
  dgRNA
  Armc9
tcgccggccgtcacc

SEQ ID NO: 70582 - DNA, 15 bp, Artificial Sequence
  dgRNA
  Ccdc108
ttgccgtcgttgcca

SEQ ID NO: 70583 - DNA, 15 bp, Artificial Sequence
  dgRNA
  Ccdc108
tgccgtcgttgccat

SEQ ID NO: 70584 - DNA, 15 bp, Artificial Sequence
  dgRNA
  Ccdc108
atcccatggcaacga

SEQ ID NO: 70585 - DNA, 15 bp, Artificial Sequence
  dgRNA
  Ccdc108
ggacacagcgtcttt

SEQ ID NO: 70586 - DNA, 15 bp, Artificial Sequence
  dgRNA
  Cep97
cagaagacggttgcc

SEQ ID NO: 70587 - DNA, 15 bp, Artificial Sequence
  dgRNA
  Cep97
ggtgtcattagcaag

SEQ ID NO: 70588 - DNA, 15 bp, Artificial Sequence
  dgRNA
  Psd3
aaagagccgagtagc

SEQ ID NO: 70589 - DNA, 15 bp, Artificial Sequence
  dgRNA
  Psd3
aagagccgagtagca

SEQ ID NO: 70590 - DNA, 15 bp, Artificial Sequence
  dgRNA
  Psd3
agagccgagtagcag

SEQ ID NO: 70591 - DNA, 15 bp, Artificial Sequence
  dgRNA
  Psd3
gccgagtagcagggg

SEQ ID NO: 70592 - DNA, 15 bp, Artificial Sequence
  dgRNA
  Cenpa
tcttcaagtacccat

SEQ ID NO: 70593 - DNA, 15 bp, Artificial Sequence
  dgRNA
  Cenpa
tctcattggtttatc

SEQ ID NO: 70594 - DNA, 15 bp, Artificial Sequence
  dgRNA
  Cenpa
gatgtcgctccacgc

SEQ ID NO: 70595 - DNA, 15 bp, Artificial Sequence
  dgRNA
  Cenpa
tttaaaagatgcggt

SEQ ID NO: 70596 - DNA, 15 bp, Artificial Sequence
  dgRNA
  Adam5
gaagagtaaacctgc

SEQ ID NO: 70597 - DNA, 15 bp, Artificial Sequence
  dgRNA
  Adam5
ctttttacagttagc

SEQ ID NO: 70598 - DNA, 15 bp, Artificial Sequence
  dgRNA
  Adam5
tagcgacaaccctgc

SEQ ID NO: 70599 - DNA, 15 bp, Artificial Sequence
  dgRNA
  Adam5
gcaggtttactcttc

SEQ ID NO: 70600 - DNA, 15 bp, Artificial Sequence
  dgRNA
  Itgb4
tccgaagaaacctag

SEQ ID NO: 70601 - DNA, 15 bp, Artificial Sequence
  dgRNA
  Itgb4
cggttcctctagtag

SEQ ID NO: 70602 - DNA, 15 bp, Artificial Sequence
  dgRNA
  Itgb4
gtctccctaccagtt

SEQ ID NO: 70603 - DNA, 15 bp, Artificial Sequence
  dgRNA
  Itgb4
tctccctaccagttt

SEQ ID NO: 70604 - DNA, 15 bp, Artificial Sequence
  dgRNA
  Rbpjl
gcacaagacacgcct

SEQ ID NO: 70605 - DNA, 15 bp, Artificial Sequence
  dgRNA
  Rbpjl
taggagaggccgcca

SEQ ID NO: 70606 - DNA, 15 bp, Artificial Sequence
  dgRNA
  Rbpjl
ccagggggcgcctgc

SEQ ID NO: 70607 - DNA, 15 bp, Artificial Sequence
  dgRNA
  Rbpjl
cagggggcgcctgct

SEQ ID NO: 70608 - DNA, 15 bp, Artificial Sequence
  dgRNA
  Olfr354
tatgagctgatctaa

SEQ ID NO: 70609 - DNA, 15 bp, Artificial Sequence
  dgRNA
  Olfr354
attgccagaactatg

SEQ ID NO: 70610 - DNA, 15 bp, Artificial Sequence
  dgRNA
  Mrps24
caccaggtccgacca

SEQ ID NO: 70611 - DNA, 15 bp, Artificial Sequence
  dgRNA
  Mrps24
ctagctgacagtatc

SEQ ID NO: 70612 - DNA, 15 bp, Artificial Sequence
  dgRNA
  Mrps24
ttaaatgcgaaaatt

SEQ ID NO: 70613 - DNA, 15 bp, Artificial Sequence
  dgRNA
  Mrps24
gtcggacctggtgtt

SEQ ID NO: 70614 - DNA, 15 bp, Artificial Sequence
  dgRNA
  Ascc3
tatcagaaccaagcg

SEQ ID NO: 70615 - DNA, 15 bp, Artificial Sequence
  dgRNA
  Ascc3
accaagcggggatta

SEQ ID NO: 70616 - DNA, 15 bp, Artificial Sequence
  dgRNA
  Ascc3
cggggattagggagt

SEQ ID NO: 70617 - DNA, 15 bp, Artificial Sequence
  dgRNA
  Ascc3
gattagggagtcggc

SEQ ID NO: 70618 - DNA, 15 bp, Artificial Sequence
  dgRNA
  Unc79
cacctttaccatcta

SEQ ID NO: 70619 - DNA, 15 bp, Artificial Sequence
  dgRNA
  Unc79
tcgctgctcagcagc

SEQ ID NO: 70620 - DNA, 15 bp, Artificial Sequence
  dgRNA
  Unc79
gagagcccatccgcc

SEQ ID NO: 70621 - DNA, 15 bp, Artificial Sequence
  dgRNA
  Unc79
agagcccatccgcca

SEQ ID NO: 70622 - DNA, 15 bp, Artificial Sequence
  dgRNA
  Nlrc4
accacatgaataacc

SEQ ID NO: 70623 - DNA, 15 bp, Artificial Sequence
  dgRNA
  Nlrc4
ataccccgattatta

SEQ ID NO: 70624 - DNA, 15 bp, Artificial Sequence
  dgRNA
  Nlrc4
tcctggttattcatg

SEQ ID NO: 70625 - DNA, 15 bp, Artificial Sequence
  dgRNA
  Nlrc4
tacgtagcaagaaaa

SEQ ID NO: 70626 - DNA, 15 bp, Artificial Sequence
  dgRNA
  Ptpn22
gcgctagggccctgc

SEQ ID NO: 70627 - DNA, 15 bp, Artificial Sequence
  dgRNA
  Ptpn22
cgctagggccctgca

SEQ ID NO: 70628 - DNA, 15 bp, Artificial Sequence
  dgRNA
  Ptpn22
gtactaatttcctct

SEQ ID NO: 70629 - DNA, 15 bp, Artificial Sequence
  dgRNA
  Mtap
gcccaggaatgcggc

SEQ ID NO: 70630 - DNA, 15 bp, Artificial Sequence
  dgRNA
  Mtap
ggggagcttttaagg

SEQ ID NO: 70631 - DNA, 15 bp, Artificial Sequence
  dgRNA
  Mtap
ggcggggagctttta

SEQ ID NO: 70632 - DNA, 15 bp, Artificial Sequence
  dgRNA
  Mtap
agcttctgtttggcg

SEQ ID NO: 70633 - DNA, 15 bp, Artificial Sequence
  dgRNA
  Lsp1
tctgtagatgggcgg

SEQ ID NO: 70634 - DNA, 15 bp, Artificial Sequence
  dgRNA
  Olfr1463
acatgcttcttaata

SEQ ID NO: 70635 - DNA, 15 bp, Artificial Sequence
  dgRNA
  Olfr1463
gtgctagttacatat

SEQ ID NO: 70636 - DNA, 15 bp, Artificial Sequence
  dgRNA
  Olfr1463
atctctacaacatcc

SEQ ID NO: 70637 - DNA, 15 bp, Artificial Sequence
  dgRNA
  Olfr1463
ctgaagtaacttgat

SEQ ID NO: 70638 - DNA, 15 bp, Artificial Sequence
  dgRNA
  Zic2
gctgagctcgccctc

SEQ ID NO: 70639 - DNA, 15 bp, Artificial Sequence
  dgRNA
  Zic2
gagctcgccctccgg

SEQ ID NO: 70640 - DNA, 15 bp, Artificial Sequence
  dgRNA
  Zic2
ctttggttctccgcc

SEQ ID NO: 70641 - DNA, 15 bp, Artificial Sequence
  dgRNA
  Zic2
gcgagctcagcgccg

SEQ ID NO: 70642 - DNA, 15 bp, Artificial Sequence
  dgRNA
  Epha8
ggggccaacgccccc

SEQ ID NO: 70643 - DNA, 15 bp, Artificial Sequence
  dgRNA
  Epha8
cccccaggcgcgagc

SEQ ID NO: 70644 - DNA, 15 bp, Artificial Sequence
  dgRNA
  Epha8
aggcgcgagccggcc

SEQ ID NO: 70645 - DNA, 15 bp, Artificial Sequence
  dgRNA
  Epha8
ggcgcgagccggccc

SEQ ID NO: 70646 - DNA, 15 bp, Artificial Sequence
  dgRNA
  Frmd8
gtagttggctgtgcg

SEQ ID NO: 70647 - DNA, 15 bp, Artificial Sequence
  dgRNA
  Frmd8
ctgtgcggggagtga

SEQ ID NO: 70648 - DNA, 15 bp, Artificial Sequence
  dgRNA
  Frmd8
ggacaatacaggact

SEQ ID NO: 70649 - DNA, 15 bp, Artificial Sequence
  dgRNA
  Frmd8
acaatacaggactcg

SEQ ID NO: 70650 - DNA, 15 bp, Artificial Sequence
  dgRNA
  9830107B12Rik
aagggtctatcctga

SEQ ID NO: 70651 - DNA, 15 bp, Artificial Sequence
  dgRNA
  9830107B12Rik
tccgtgagtgcatct

SEQ ID NO: 70652 - DNA, 15 bp, Artificial Sequence
  dgRNA
  9830107B12Rik
ccgtgagtgcatctt

SEQ ID NO: 70653 - DNA, 15 bp, Artificial Sequence
  dgRNA
  9830107B12Rik
ggccttatggagacc

SEQ ID NO: 70654 - DNA, 15 bp, Artificial Sequence
  dgRNA
  Parvg
gattgtctggattga

SEQ ID NO: 70655 - DNA, 15 bp, Artificial Sequence
  dgRNA
  Parvg
attgatggagaggcg

SEQ ID NO: 70656 - DNA, 15 bp, Artificial Sequence
  dgRNA
  Parvg
ttgatggagaggcgg

SEQ ID NO: 70657 - DNA, 15 bp, Artificial Sequence
  dgRNA
  Parvg
gaccccgtgatgcca

SEQ ID NO: 70658 - DNA, 15 bp, Artificial Sequence
  dgRNA
  Mogs
tcacccatcgagtcc

SEQ ID NO: 70659 - DNA, 15 bp, Artificial Sequence
  dgRNA
  Mogs
agcgcttccgggctt

SEQ ID NO: 70660 - DNA, 15 bp, Artificial Sequence
  dgRNA
  Mogs
tccgggcttcggggc

SEQ ID NO: 70661 - DNA, 15 bp, Artificial Sequence
  dgRNA
  Mogs
gacctgacgtgaaag

SEQ ID NO: 70662 - DNA, 15 bp, Artificial Sequence
  dgRNA
  Arcn1
gcaccaaataaacgc

SEQ ID NO: 70663 - DNA, 15 bp, Artificial Sequence
  dgRNA
  Arcn1
aatcctgggctaaca

SEQ ID NO: 70664 - DNA, 15 bp, Artificial Sequence
  dgRNA
  Arcn1
ggcttcggagcttac

SEQ ID NO: 70665 - DNA, 15 bp, Artificial Sequence
  dgRNA
  Arcn1
tcgcctgcgtttatt

SEQ ID NO: 70666 - DNA, 15 bp, Artificial Sequence
  dgRNA
  Olfr427
atatgccgaattgtt

SEQ ID NO: 70667 - DNA, 15 bp, Artificial Sequence
  dgRNA
  Olfr427
cagaagtttatcgga

SEQ ID NO: 70668 - DNA, 15 bp, Artificial Sequence
  dgRNA
  Dsp
ctgctcaggcttcgg

SEQ ID NO: 70669 - DNA, 15 bp, Artificial Sequence
  dgRNA
  Dsp
aggcttcggtggcgc

SEQ ID NO: 70670 - DNA, 15 bp, Artificial Sequence
  dgRNA
  Dsp
ggcttcggtggcgca

SEQ ID NO: 70671 - DNA, 15 bp, Artificial Sequence
  dgRNA
  Dsp
ttcggtggcgcaggg

SEQ ID NO: 70672 - DNA, 15 bp, Artificial Sequence
  dgRNA
  Acbd5
tcaccgcggcggagc

SEQ ID NO: 70673 - DNA, 15 bp, Artificial Sequence
  dgRNA
  Acbd5
ccacccgctccgccg

SEQ ID NO: 70674 - DNA, 15 bp, Artificial Sequence
  dgRNA
  Rtn4r
acaccccgtacccac

SEQ ID NO: 70675 - DNA, 15 bp, Artificial Sequence
  dgRNA
  Rtn4r
cggtccgccccagcg

SEQ ID NO: 70676 - DNA, 15 bp, Artificial Sequence
  dgRNA
  Rtn4r
ggtgagcgccccgcc

SEQ ID NO: 70677 - DNA, 15 bp, Artificial Sequence
  dgRNA
  Rtn4r
cccgcccggaccggc

SEQ ID NO: 70678 - DNA, 15 bp, Artificial Sequence
  dgRNA
  Btnl2
aggtcacctacctgc

SEQ ID NO: 70679 - DNA, 15 bp, Artificial Sequence
  dgRNA
  Btnl2
gtccagcctgcgtgc

SEQ ID NO: 70680 - DNA, 15 bp, Artificial Sequence
  dgRNA
  Btnl2
agaacaccagcacgc

SEQ ID NO: 70681 - DNA, 15 bp, Artificial Sequence
  dgRNA
  Shh
aaagcaggcagtgcg

SEQ ID NO: 70682 - DNA, 15 bp, Artificial Sequence
  dgRNA
  Shh
aggaggcctgtttat

SEQ ID NO: 70683 - DNA, 15 bp, Artificial Sequence
  dgRNA
  Shh
tactaaggtaaaggt

SEQ ID NO: 70684 - DNA, 15 bp, Artificial Sequence
  dgRNA
  Shh
tctttactaaggtaa

SEQ ID NO: 70685 - DNA, 15 bp, Artificial Sequence
  dgRNA
  Slc39a8
gatcgtttcatccac

SEQ ID NO: 70686 - DNA, 15 bp, Artificial Sequence
  dgRNA
  Slc39a8
tgcggatatcccgag

SEQ ID NO: 70687 - DNA, 15 bp, Artificial Sequence
  dgRNA
  Slc39a8
atcccgagcggcgtc

SEQ ID NO: 70688 - DNA, 15 bp, Artificial Sequence
  dgRNA
  Slc39a8
cgagcggcgtcagga

SEQ ID NO: 70689 - DNA, 15 bp, Artificial Sequence
  dgRNA
  Olfr1489
tataaggagccatag

SEQ ID NO: 70690 - DNA, 15 bp, Artificial Sequence
  dgRNA
  1700018F24Rik
gcttaacagtcctcg

SEQ ID NO: 70691 - DNA, 15 bp, Artificial Sequence
  dgRNA
  Armc9
tgacggccggcgagc

SEQ ID NO: 70692 - DNA, 15 bp, Artificial Sequence
  dgRNA
  Armc9
cggccggcgagctgg

SEQ ID NO: 70693 - DNA, 15 bp, Artificial Sequence
  dgRNA
  Armc9
agaccgccagctcgc

SEQ ID NO: 70694 - DNA, 15 bp, Artificial Sequence
  dgRNA
  Olfr1487
agggagttatttacc

SEQ ID NO: 70695 - DNA, 15 bp, Artificial Sequence
  dgRNA
  Mrps12
ccaatcagacgcgca

SEQ ID NO: 70696 - DNA, 15 bp, Artificial Sequence
  dgRNA
  Mrps12
ggagatttcccgccc

SEQ ID NO: 70697 - DNA, 15 bp, Artificial Sequence
  dgRNA
  Mrps12
gaatcccttccaatg

SEQ ID NO: 70698 - DNA, 15 bp, Artificial Sequence
  dgRNA
  Mrps12
tcccttcagtgacgc

SEQ ID NO: 70699 - DNA, 15 bp, Artificial Sequence
  dgRNA
  Vmn1r198
ctatcatcacttgaa

SEQ ID NO: 70700 - DNA, 15 bp, Artificial Sequence
  dgRNA
  Vmn1r198
tatcatcacttgaat

SEQ ID NO: 70701 - DNA, 15 bp, Artificial Sequence
  dgRNA
  Vmn1r198
atcacttgaatgggg

SEQ ID NO: 70702 - DNA, 15 bp, Artificial Sequence
  dgRNA
  Vmn1r198
tgatagctacaatca

SEQ ID NO: 70703 - DNA, 15 bp, Artificial Sequence
  dgRNA
  D11Wsu47e
ccccgtttaggtgtc

SEQ ID NO: 70704 - DNA, 15 bp, Artificial Sequence
  dgRNA
  D11Wsu47e
cccgtttaggtgtcc

SEQ ID NO: 70705 - DNA, 15 bp, Artificial Sequence
  dgRNA
  D11Wsu47e
ccgtttaggtgtccg

SEQ ID NO: 70706 - DNA, 15 bp, Artificial Sequence
  dgRNA
  D11Wsu47e
cgttaagcctctcta

SEQ ID NO: 70707 - DNA, 15 bp, Artificial Sequence
  dgRNA
  Pogz
ggcggaagtgacgag

SEQ ID NO: 70708 - DNA, 15 bp, Artificial Sequence
  dgRNA
  Pogz
agaggtatccctccg

SEQ ID NO: 70709 - DNA, 15 bp, Artificial Sequence
  dgRNA
  Pogz
gaggtatccctccgc

SEQ ID NO: 70710 - DNA, 15 bp, Artificial Sequence
  dgRNA
  Pogz
aggtatccctccgcg

SEQ ID NO: 70711 - DNA, 15 bp, Artificial Sequence
  dgRNA
  Atrx
caagagcgcattttc

SEQ ID NO: 70712 - DNA, 15 bp, Artificial Sequence
  dgRNA
  Atrx
gaccccactaagaag

SEQ ID NO: 70713 - DNA, 15 bp, Artificial Sequence
  dgRNA
  Atrx
gaccgccttagcaac

SEQ ID NO: 70714 - DNA, 15 bp, Artificial Sequence
  dgRNA
  Atrx
ctacttccacataat

SEQ ID NO: 70715 - DNA, 15 bp, Artificial Sequence
  dgRNA
  Glrx2
actttctgaaagcgc

SEQ ID NO: 70716 - DNA, 15 bp, Artificial Sequence
  dgRNA
  Glrx2
atttgccagatcatt

SEQ ID NO: 70717 - DNA, 15 bp, Artificial Sequence
  dgRNA
  Glrx2
cctattggagatatc

SEQ ID NO: 70718 - DNA, 15 bp, Artificial Sequence
  dgRNA
  Glrx2
acagctgcctaggcc

SEQ ID NO: 70719 - DNA, 15 bp, Artificial Sequence
  dgRNA
  Ipp
tgcatggagcggaat

SEQ ID NO: 70720 - DNA, 15 bp, Artificial Sequence
  dgRNA
  Ipp
gcatggagcggaata

SEQ ID NO: 70721 - DNA, 15 bp, Artificial Sequence
  dgRNA
  Ipp
aagaacctgcctccg

SEQ ID NO: 70722 - DNA, 15 bp, Artificial Sequence
  dgRNA
  Ipp
tccgcggccagcaag

SEQ ID NO: 70723 - DNA, 15 bp, Artificial Sequence
  dgRNA
  Sprr2k
gggggagtccttctt

SEQ ID NO: 70724 - DNA, 15 bp, Artificial Sequence
  dgRNA
  Sprr2k
taggctagttatata

SEQ ID NO: 70725 - DNA, 15 bp, Artificial Sequence
  dgRNA
  Sprr2k
agctttacatcctac

SEQ ID NO: 70726 - DNA, 15 bp, Artificial Sequence
  dgRNA
  Sprr2k
gctttacatcctact

SEQ ID NO: 70727 - DNA, 15 bp, Artificial Sequence
  dgRNA
  Dld
ctagttcgtctttca

SEQ ID NO: 70728 - DNA, 15 bp, Artificial Sequence
  dgRNA
  Dld
gcacgacgaagcgac

SEQ ID NO: 70729 - DNA, 15 bp, Artificial Sequence
  dgRNA
  Dld
aatcgcgctgctcct

SEQ ID NO: 70730 - DNA, 15 bp, Artificial Sequence
  dgRNA
  Dld
tgttgctcaaatgac

SEQ ID NO: 70731 - DNA, 15 bp, Artificial Sequence
  dgRNA
  Mast1
aggtgcattgggatg

SEQ ID NO: 70732 - DNA, 15 bp, Artificial Sequence
  dgRNA
  Mast1
cccaggtagggcatc

SEQ ID NO: 70733 - DNA, 15 bp, Artificial Sequence
  dgRNA
  Mast1
atcaggcgtgcacac

SEQ ID NO: 70734 - DNA, 15 bp, Artificial Sequence
  dgRNA
  Mast1
aggcgtgcacacggg

SEQ ID NO: 70735 - DNA, 15 bp, Artificial Sequence
  dgRNA
  Rxra
taggctcagcctacg

SEQ ID NO: 70736 - DNA, 15 bp, Artificial Sequence
  dgRNA
  Rxra
aggctcagcctacga

SEQ ID NO: 70737 - DNA, 15 bp, Artificial Sequence
  dgRNA
  Rxra
ggctcagcctacgag

SEQ ID NO: 70738 - DNA, 15 bp, Artificial Sequence
  dgRNA
  Rxra
cagcctacgaggggt

SEQ ID NO: 70739 - DNA, 15 bp, Artificial Sequence
  dgRNA
  Zfp382
atgcactcccgcgcg

SEQ ID NO: 70740 - DNA, 15 bp, Artificial Sequence
  dgRNA
  Zfp382
gccacagaccgtagc

SEQ ID NO: 70741 - DNA, 15 bp, Artificial Sequence
  dgRNA
  Zfp382
acccgccccagccaa

SEQ ID NO: 70742 - DNA, 15 bp, Artificial Sequence
  dgRNA
  Zfp382
cagccaaggggacgc

SEQ ID NO: 70743 - DNA, 15 bp, Artificial Sequence
  dgRNA
  Guca1a
gatcagagcagccgc

SEQ ID NO: 70744 - DNA, 15 bp, Artificial Sequence
  dgRNA
  Guca1a
ccggcatctctagtt

SEQ ID NO: 70745 - DNA, 15 bp, Artificial Sequence
  dgRNA
  Guca1a
ttaacaggatctggt

SEQ ID NO: 70746 - DNA, 15 bp, Artificial Sequence
  dgRNA
  Guca1a
cttaacaggatctgg

SEQ ID NO: 70747 - DNA, 15 bp, Artificial Sequence
  dgRNA
  Ndfip2
ctggggactaataaa

SEQ ID NO: 70748 - DNA, 15 bp, Artificial Sequence
  dgRNA
  Ndfip2
gggcgacctgtcctc

SEQ ID NO: 70749 - DNA, 15 bp, Artificial Sequence
  dgRNA
  Ndfip2
gaaacctgccctcac

SEQ ID NO: 70750 - DNA, 15 bp, Artificial Sequence
  dgRNA
  Ndfip2
cgtcactgcggaggg

SEQ ID NO: 70751 - DNA, 15 bp, Artificial Sequence
  dgRNA
  Kcnj3
ggagaggcatccgga

SEQ ID NO: 70752 - DNA, 15 bp, Artificial Sequence
  dgRNA
  Kcnj3
agaggcatccggacg

SEQ ID NO: 70753 - DNA, 15 bp, Artificial Sequence
  dgRNA
  Kcnj3
ctggtttgcagcgct

SEQ ID NO: 70754 - DNA, 15 bp, Artificial Sequence
  dgRNA
  Kcnj3
agtctttgccccgtc

SEQ ID NO: 70755 - DNA, 15 bp, Artificial Sequence
  dgRNA
  Ang4
aatgtgtggtccacc

SEQ ID NO: 70756 - DNA, 15 bp, Artificial Sequence
  dgRNA
  Ang4
cgtgattagtgtcct

SEQ ID NO: 70757 - DNA, 15 bp, Artificial Sequence
  dgRNA
  Ang4
atagtaaccacctgg

SEQ ID NO: 70758 - DNA, 15 bp, Artificial Sequence
  dgRNA
  Ang4
cagatagtaaccacc

SEQ ID NO: 70759 - DNA, 15 bp, Artificial Sequence
  dgRNA
  Synpo2l
actaagtgatctatc

SEQ ID NO: 70760 - DNA, 15 bp, Artificial Sequence
  dgRNA
  Vps41
aaccagattagtgtg

SEQ ID NO: 70761 - DNA, 15 bp, Artificial Sequence
  dgRNA
  Vps41
accagattagtgtgc

SEQ ID NO: 70762 - DNA, 15 bp, Artificial Sequence
  dgRNA
  Vps41
tcccgcacactaatc

SEQ ID NO: 70763 - DNA, 15 bp, Artificial Sequence
  dgRNA
  Vps41
gggccacagcctact

SEQ ID NO: 70764 - DNA, 15 bp, Artificial Sequence
  dgRNA
  Cnr1
gggccagcgccgcgg

SEQ ID NO: 70765 - DNA, 15 bp, Artificial Sequence
  dgRNA
  Cnr1
ggccagcgccgcggc

SEQ ID NO: 70766 - DNA, 15 bp, Artificial Sequence
  dgRNA
  Cnr1
ccgcgcagcaaagtt

SEQ ID NO: 70767 - DNA, 15 bp, Artificial Sequence
  dgRNA
  Cnr1
aaagtttggagccgc

SEQ ID NO: 70768 - DNA, 15 bp, Artificial Sequence
  dgRNA
  Dmrt1
cctccaagcaaccat

SEQ ID NO: 70769 - DNA, 15 bp, Artificial Sequence
  dgRNA
  Dmrt1
ctggtgcgctgcaca

SEQ ID NO: 70770 - DNA, 15 bp, Artificial Sequence
  dgRNA
  Dmrt1
cgctgcacacggctg

SEQ ID NO: 70771 - DNA, 15 bp, Artificial Sequence
  dgRNA
  Dmrt1
tagcaattttgcagc

SEQ ID NO: 70772 - DNA, 15 bp, Artificial Sequence
  dgRNA
  Ccer2
tctccctgagccggg

SEQ ID NO: 70773 - DNA, 15 bp, Artificial Sequence
  dgRNA
  Ccer2
cgtcatccccccttg

SEQ ID NO: 70774 - DNA, 15 bp, Artificial Sequence
  dgRNA
  Ccer2
gtcatccccccttgc

SEQ ID NO: 70775 - DNA, 15 bp, Artificial Sequence
  dgRNA
  Ccer2
tcatccccccttgcg

SEQ ID NO: 70776 - DNA, 15 bp, Artificial Sequence
  dgRNA
  Pkib
acgtaggtctcctag

SEQ ID NO: 70777 - DNA, 15 bp, Artificial Sequence
  dgRNA
  Csgalnact1
cctcgggctcccact

SEQ ID NO: 70778 - DNA, 15 bp, Artificial Sequence
  dgRNA
  Csgalnact1
cgggctcccactcgg

SEQ ID NO: 70779 - DNA, 15 bp, Artificial Sequence
  dgRNA
  Csgalnact1
ctcccactcggaggc

SEQ ID NO: 70780 - DNA, 15 bp, Artificial Sequence
  dgRNA
  Csgalnact1
ggccggcgctgtgct

SEQ ID NO: 70781 - DNA, 15 bp, Artificial Sequence
  dgRNA
  Dlx3
ggggtaacaacaaag

SEQ ID NO: 70782 - DNA, 15 bp, Artificial Sequence
  dgRNA
  Dlx3
cgtgttttgcctcga

SEQ ID NO: 70783 - DNA, 15 bp, Artificial Sequence
  dgRNA
  Dlx3
cgcaggagcctccct

SEQ ID NO: 70784 - DNA, 15 bp, Artificial Sequence
  dgRNA
  Dlx3
cattgagtctataac

SEQ ID NO: 70785 - DNA, 15 bp, Artificial Sequence
  dgRNA
  Vstm2b
ggagcaccggactga

SEQ ID NO: 70786 - DNA, 15 bp, Artificial Sequence
  dgRNA
  Vstm2b
gcaccggactgaagg

SEQ ID NO: 70787 - DNA, 15 bp, Artificial Sequence
  dgRNA
  Vstm2b
ggaggtacagaccga

SEQ ID NO: 70788 - DNA, 15 bp, Artificial Sequence
  dgRNA
  Vstm2b
accgaaggatcctcc

SEQ ID NO: 70789 - DNA, 15 bp, Artificial Sequence
  dgRNA
  Olfml2a
ccccagtacgtcgcg

SEQ ID NO: 70790 - DNA, 15 bp, Artificial Sequence
  dgRNA
  Olfml2a
acctctcttactgcc

SEQ ID NO: 70791 - DNA, 15 bp, Artificial Sequence
  dgRNA
  Olfml2a
caaattgcaaagacg

SEQ ID NO: 70792 - DNA, 15 bp, Artificial Sequence
  dgRNA
  Olfml2a
aaattgcaaagacgc

SEQ ID NO: 70793 - DNA, 15 bp, Artificial Sequence
  dgRNA
  Defb47
taagcttcactggtc

SEQ ID NO: 70794 - DNA, 15 bp, Artificial Sequence
  dgRNA
  Defb47
cttaacctgcaaaga

SEQ ID NO: 70795 - DNA, 15 bp, Artificial Sequence
  dgRNA
  Defb47
acttctgggggcccg

SEQ ID NO: 70796 - DNA, 15 bp, Artificial Sequence
  dgRNA
  Defb47
gctggtgaggctcgg

SEQ ID NO: 70797 - DNA, 15 bp, Artificial Sequence
  dgRNA
  Alg10b
ataaatgctccactc

SEQ ID NO: 70798 - DNA, 15 bp, Artificial Sequence
  dgRNA
  Alg10b
gctccactccggaac

SEQ ID NO: 70799 - DNA, 15 bp, Artificial Sequence
  dgRNA
  Alg10b
gccgccgctaggctc

SEQ ID NO: 70800 - DNA, 15 bp, Artificial Sequence
  dgRNA
  Alg10b
cgcgggagctgttgt

SEQ ID NO: 70801 - DNA, 15 bp, Artificial Sequence
  dgRNA
  Slc2a3
gtcggctcttgaaaa

SEQ ID NO: 70802 - DNA, 15 bp, Artificial Sequence
  dgRNA
  Slc2a3
tcggctcttgaaaag

SEQ ID NO: 70803 - DNA, 15 bp, Artificial Sequence
  dgRNA
  Slc2a3
gttttcattataggc

SEQ ID NO: 70804 - DNA, 15 bp, Artificial Sequence
  dgRNA
  Slc2a3
atgcgttttcattat

SEQ ID NO: 70805 - DNA, 15 bp, Artificial Sequence
  dgRNA
  Kcnh5
ggcgcagggccattc

SEQ ID NO: 70806 - DNA, 15 bp, Artificial Sequence
  dgRNA
  Kcnh5
gcgcagggccattcc

SEQ ID NO: 70807 - DNA, 15 bp, Artificial Sequence
  dgRNA
  Kcnh5
ctctcatattccatc

SEQ ID NO: 70808 - DNA, 15 bp, Artificial Sequence
  dgRNA
  Kcnh5
ttctgctccaaatag

SEQ ID NO: 70809 - DNA, 15 bp, Artificial Sequence
  dgRNA
  Vmn1r179
catgcattgttctcc

SEQ ID NO: 70810 - DNA, 15 bp, Artificial Sequence
  dgRNA
  Vmn1r179
atcaattgcaaagct

SEQ ID NO: 70811 - DNA, 15 bp, Artificial Sequence
  dgRNA
  Vmn1r179
tcaagactccaatac

SEQ ID NO: 70812 - DNA, 15 bp, Artificial Sequence
  dgRNA
  Ssmem1
ttcagcaggaagccg

SEQ ID NO: 70813 - DNA, 15 bp, Artificial Sequence
  dgRNA
  Ssmem1
gcaagactaaggcgg

SEQ ID NO: 70814 - DNA, 15 bp, Artificial Sequence
  dgRNA
  Ssmem1
cggcggcgggcaagc

SEQ ID NO: 70815 - DNA, 15 bp, Artificial Sequence
  dgRNA
  Ssmem1
ggcggcgggcaagcc

SEQ ID NO: 70816 - DNA, 15 bp, Artificial Sequence
  dgRNA
  Sfmbt2
tctaccacgaagagc

SEQ ID NO: 70817 - DNA, 15 bp, Artificial Sequence
  dgRNA
  Sfmbt2
acattttgcgagcat

SEQ ID NO: 70818 - DNA, 15 bp, Artificial Sequence
  dgRNA
  Sfmbt2
gcgagcattggaaaa

SEQ ID NO: 70819 - DNA, 15 bp, Artificial Sequence
  dgRNA
  Sfmbt2
gaaaaaggtcgttga

SEQ ID NO: 70820 - DNA, 15 bp, Artificial Sequence
  dgRNA
  Gpd2
aggatcgataacctc

SEQ ID NO: 70821 - DNA, 15 bp, Artificial Sequence
  dgRNA
  Gpd2
cgataacctcgggca

SEQ ID NO: 70822 - DNA, 15 bp, Artificial Sequence
  dgRNA
  Gpd2
gccgccctttcccac

SEQ ID NO: 70823 - DNA, 15 bp, Artificial Sequence
  dgRNA
  Gpd2
tccgcatttccctgc

SEQ ID NO: 70824 - DNA, 15 bp, Artificial Sequence
  dgRNA
  Olfr281
caatgatgagctaac

SEQ ID NO: 70825 - DNA, 15 bp, Artificial Sequence
  dgRNA
  Olfr281
agctctaagatgcct

SEQ ID NO: 70826 - DNA, 15 bp, Artificial Sequence
  dgRNA
  Olfr281
ctcaccggcatttac

SEQ ID NO: 70827 - DNA, 15 bp, Artificial Sequence
  dgRNA
  Zswim8
gtaccaagtaattgc

SEQ ID NO: 70828 - DNA, 15 bp, Artificial Sequence
  dgRNA
  Zswim8
ccgttcctattcctt

SEQ ID NO: 70829 - DNA, 15 bp, Artificial Sequence
  dgRNA
  Zswim8
gctcgagaaaactgc

SEQ ID NO: 70830 - DNA, 15 bp, Artificial Sequence
  dgRNA
  Zswim8
acacccgcccgtacg

SEQ ID NO: 70831 - DNA, 15 bp, Artificial Sequence
  dgRNA
  Styxl1
caacccggtactaga

SEQ ID NO: 70832 - DNA, 15 bp, Artificial Sequence
  dgRNA
  Styxl1
tactagaaggactct

SEQ ID NO: 70833 - DNA, 15 bp, Artificial Sequence
  dgRNA
  Styxl1
cttggagcgctcgcc

SEQ ID NO: 70834 - DNA, 15 bp, Artificial Sequence
  dgRNA
  Styxl1
ggagcgctcgcccgg

SEQ ID NO: 70835 - DNA, 15 bp, Artificial Sequence
  dgRNA
  Ahcy
gattcactggctgga

SEQ ID NO: 70836 - DNA, 15 bp, Artificial Sequence
  dgRNA
  Ahcy
actggctggacggat

SEQ ID NO: 70837 - DNA, 15 bp, Artificial Sequence
  dgRNA
  Ahcy
tcctagtcgagtgcc

SEQ ID NO: 70838 - DNA, 15 bp, Artificial Sequence
  dgRNA
  Ahcy
cctagtcgagtgcca

SEQ ID NO: 70839 - DNA, 15 bp, Artificial Sequence
  dgRNA
  Serpinb9
gggttagtgtttgcc

SEQ ID NO: 70840 - DNA, 15 bp, Artificial Sequence
  dgRNA
  Serpinb9
atggatttagacacg

SEQ ID NO: 70841 - DNA, 15 bp, Artificial Sequence
  dgRNA
  Serpinb9
cacttgccaccccgc

SEQ ID NO: 70842 - DNA, 15 bp, Artificial Sequence
  dgRNA
  Serpinb9
cactaacccattttc

SEQ ID NO: 70843 - DNA, 15 bp, Artificial Sequence
  dgRNA
  Fam83b
ctattgatggcattt

SEQ ID NO: 70844 - DNA, 15 bp, Artificial Sequence
  dgRNA
  Fam83b
tcttatcccgcactc

SEQ ID NO: 70845 - DNA, 15 bp, Artificial Sequence
  dgRNA
  Fam83b
taactaccgtttaaa

SEQ ID NO: 70846 - DNA, 15 bp, Artificial Sequence
  dgRNA
  Fam83b
ttaactaccgtttaa

SEQ ID NO: 70847 - DNA, 15 bp, Artificial Sequence
  dgRNA
  Msantd3
gtgggggactgcacg

SEQ ID NO: 70848 - DNA, 15 bp, Artificial Sequence
  dgRNA
  Msantd3
cctccgcggcgccca

SEQ ID NO: 70849 - DNA, 15 bp, Artificial Sequence
  dgRNA
  Msantd3
gcggcgcccacggag

SEQ ID NO: 70850 - DNA, 15 bp, Artificial Sequence
  dgRNA
  Msantd3
cgcccacggagcggc

SEQ ID NO: 70851 - DNA, 15 bp, Artificial Sequence
  dgRNA
  Med24
cgtacctcagctctt

SEQ ID NO: 70852 - DNA, 15 bp, Artificial Sequence
  dgRNA
  Med24
ttgctacgtttctat

SEQ ID NO: 70853 - DNA, 15 bp, Artificial Sequence
  dgRNA
  Med24
tacgtttctattggt

SEQ ID NO: 70854 - DNA, 15 bp, Artificial Sequence
  dgRNA
  Med24
ggtgtgtgttgccgc

SEQ ID NO: 70855 - DNA, 15 bp, Artificial Sequence
  dgRNA
  Capzb
aggtttgcccctttc

SEQ ID NO: 70856 - DNA, 15 bp, Artificial Sequence
  dgRNA
  Capzb
ggtttgcccctttct

SEQ ID NO: 70857 - DNA, 15 bp, Artificial Sequence
  dgRNA
  Capzb
gtttgcccctttctg

SEQ ID NO: 70858 - DNA, 15 bp, Artificial Sequence
  dgRNA
  Capzb
ctggggaggccgctt

SEQ ID NO: 70859 - DNA, 15 bp, Artificial Sequence
  dgRNA
  Olfr648
gtaaccacggtgtat

SEQ ID NO: 70860 - DNA, 15 bp, Artificial Sequence
  dgRNA
  Olfr648
taaccacggtgtatc

SEQ ID NO: 70861 - DNA, 15 bp, Artificial Sequence
  dgRNA
  Olfr648
aggcataagggtaca

SEQ ID NO: 70862 - DNA, 15 bp, Artificial Sequence
  dgRNA
  Olfr648
ggctaggtgacaacg

SEQ ID NO: 70863 - DNA, 15 bp, Artificial Sequence
  dgRNA
  Ube2r2
cgagaccccagcgca

SEQ ID NO: 70864 - DNA, 15 bp, Artificial Sequence
  dgRNA
  Ube2r2
cctcgtgcgcccctc

SEQ ID NO: 70865 - DNA, 15 bp, Artificial Sequence
  dgRNA
  Ube2r2
cccgcggagaacgag

SEQ ID NO: 70866 - DNA, 15 bp, Artificial Sequence
  dgRNA
  Ube2r2
gagggcgagcgagca

SEQ ID NO: 70867 - DNA, 15 bp, Artificial Sequence
  dgRNA
  Rap1b
cgccagggcccgcct

SEQ ID NO: 70868 - DNA, 15 bp, Artificial Sequence
  dgRNA
  Rap1b
tgcgcgccccgcccg

SEQ ID NO: 70869 - DNA, 15 bp, Artificial Sequence
  dgRNA
  Rap1b
cgccccgcccgcggg

SEQ ID NO: 70870 - DNA, 15 bp, Artificial Sequence
  dgRNA
  Rap1b
gcggaagcgagagcg

SEQ ID NO: 70871 - DNA, 15 bp, Artificial Sequence
  dgRNA
  Ptger2
gcaagtcgttgttat

SEQ ID NO: 70872 - DNA, 15 bp, Artificial Sequence
  dgRNA
  Ptger2
gtcgttgttatagga

SEQ ID NO: 70873 - DNA, 15 bp, Artificial Sequence
  dgRNA
  Ptger2
cagttaaccattcga

SEQ ID NO: 70874 - DNA, 15 bp, Artificial Sequence
  dgRNA
  Vpreb1
acaagcccgcagtcc

SEQ ID NO: 70875 - DNA, 15 bp, Artificial Sequence
  dgRNA
  Vpreb1
caagcccgcagtcct

SEQ ID NO: 70876 - DNA, 15 bp, Artificial Sequence
  dgRNA
  Vpreb1
cgcagtcctgggttc

SEQ ID NO: 70877 - DNA, 15 bp, Artificial Sequence
  dgRNA
  Vpreb1
ccatgacgttccagc

SEQ ID NO: 70878 - DNA, 15 bp, Artificial Sequence
  dgRNA
  Prr23a1
tcagcatgacgctcc

SEQ ID NO: 70879 - DNA, 15 bp, Artificial Sequence
  dgRNA
  Prr23a1
cagcatgacgctcct

SEQ ID NO: 70880 - DNA, 15 bp, Artificial Sequence
  dgRNA
  Prr23a1
catgacgctcctggg

SEQ ID NO: 70881 - DNA, 15 bp, Artificial Sequence
  dgRNA
  Prr23a1
aatgtatccggcgtg

SEQ ID NO: 70882 - DNA, 15 bp, Artificial Sequence
  dgRNA
  Dcun1d5
gaaaggacttcccgc

SEQ ID NO: 70883 - DNA, 15 bp, Artificial Sequence
  dgRNA
  Dcun1d5
ccgccagaaaatctc

SEQ ID NO: 70884 - DNA, 15 bp, Artificial Sequence
  dgRNA
  Dcun1d5
aatctccggagattc

SEQ ID NO: 70885 - DNA, 15 bp, Artificial Sequence
  dgRNA
  Dcun1d5
tagagagaccgctcc

SEQ ID NO: 70886 - DNA, 15 bp, Artificial Sequence
  dgRNA
  Pax3
gagctagtccccctc

SEQ ID NO: 70887 - DNA, 15 bp, Artificial Sequence
  dgRNA
  Pax3
agctagtccccctct

SEQ ID NO: 70888 - DNA, 15 bp, Artificial Sequence
  dgRNA
  Pax3
ccccctctgggtcgg

SEQ ID NO: 70889 - DNA, 15 bp, Artificial Sequence
  dgRNA
  Pax3
cctctgggtcggcgg

SEQ ID NO: 70890 - DNA, 15 bp, Artificial Sequence
  dgRNA
  Psmd4
ttggtgatgagcacc

SEQ ID NO: 70891 - DNA, 15 bp, Artificial Sequence
  dgRNA
  Psmd4
caccaggccaatcgg

SEQ ID NO: 70892 - DNA, 15 bp, Artificial Sequence
  dgRNA
  Psmd4
tgtcagtcccggagc

SEQ ID NO: 70893 - DNA, 15 bp, Artificial Sequence
  dgRNA
  Psmd4
cacctccgattggcc

SEQ ID NO: 70894 - DNA, 15 bp, Artificial Sequence
  dgRNA
  Gusb
cagatcttagcctag

SEQ ID NO: 70895 - DNA, 15 bp, Artificial Sequence
  dgRNA
  Gusb
gcctagtggtcctga

SEQ ID NO: 70896 - DNA, 15 bp, Artificial Sequence
  dgRNA
  Slc25a14
ctggtaaatgcagcg

SEQ ID NO: 70897 - DNA, 15 bp, Artificial Sequence
  dgRNA
  Slc25a14
tggtaaatgcagcgt

SEQ ID NO: 70898 - DNA, 15 bp, Artificial Sequence
  dgRNA
  Slc25a14
taaatgcagcgtggg

SEQ ID NO: 70899 - DNA, 15 bp, Artificial Sequence
  dgRNA
  Slc25a14
aaatgcagcgtgggc

SEQ ID NO: 70900 - DNA, 15 bp, Artificial Sequence
  dgRNA
  S1pr5
gaagctaggacttgc

SEQ ID NO: 70901 - DNA, 15 bp, Artificial Sequence
  dgRNA
  S1pr5
taccagtcgccgctg

SEQ ID NO: 70902 - DNA, 15 bp, Artificial Sequence
  dgRNA
  S1pr5
cgctgaggcgctctc

SEQ ID NO: 70903 - DNA, 15 bp, Artificial Sequence
  dgRNA
  S1pr5
cgctctccggtgccg

SEQ ID NO: 70904 - DNA, 15 bp, Artificial Sequence
  dgRNA
  Igfbp1
cccgtggtgatggac

SEQ ID NO: 70905 - DNA, 15 bp, Artificial Sequence
  dgRNA
  Igfbp1
actatgtttgtcccg

SEQ ID NO: 70906 - DNA, 15 bp, Artificial Sequence
  dgRNA
  Igfbp1
accgtgggtggaagg

SEQ ID NO: 70907 - DNA, 15 bp, Artificial Sequence
  dgRNA
  Igfbp1
aaccgtgggtggaag

SEQ ID NO: 70908 - DNA, 15 bp, Artificial Sequence
  dgRNA
  Mbd3l2
aactgtctataaggc

SEQ ID NO: 70909 - DNA, 15 bp, Artificial Sequence
  dgRNA
  Mbd3l2
caaaaactgtctata

SEQ ID NO: 70910 - DNA, 15 bp, Artificial Sequence
  dgRNA
  Fam132a
ctcccaactccttag

SEQ ID NO: 70911 - DNA, 15 bp, Artificial Sequence
  dgRNA
  Fam132a
gaatcactggtcata

SEQ ID NO: 70912 - DNA, 15 bp, Artificial Sequence
  dgRNA
  Fam132a
tctatttagttaagc

SEQ ID NO: 70913 - DNA, 15 bp, Artificial Sequence
  dgRNA
  Fam132a
cacccctaaggagtt

SEQ ID NO: 70914 - DNA, 15 bp, Artificial Sequence
  dgRNA
  Mitf
cccctgtgcagatcg

SEQ ID NO: 70915 - DNA, 15 bp, Artificial Sequence
  dgRNA
  Mitf
cccctcaggtgccat

SEQ ID NO: 70916 - DNA, 15 bp, Artificial Sequence
  dgRNA
  Mitf
aggtgccataggtac

SEQ ID NO: 70917 - DNA, 15 bp, Artificial Sequence
  dgRNA
  Mitf
ggtactggattaagc

SEQ ID NO: 70918 - DNA, 15 bp, Artificial Sequence
  dgRNA
  Fam222a
tctctgcaacctgcg

SEQ ID NO: 70919 - DNA, 15 bp, Artificial Sequence
  dgRNA
  Fam222a
ggggccggtgcacgc

SEQ ID NO: 70920 - DNA, 15 bp, Artificial Sequence
  dgRNA
  Fam222a
gggccggtgcacgcc

SEQ ID NO: 70921 - DNA, 15 bp, Artificial Sequence
  dgRNA
  Fam222a
gccgggcgaggagcc

SEQ ID NO: 70922 - DNA, 15 bp, Artificial Sequence
  dgRNA
  Nup133
gcactggatccaccg

SEQ ID NO: 70923 - DNA, 15 bp, Artificial Sequence
  dgRNA
  Nup133
tccaccgcggtgaat

SEQ ID NO: 70924 - DNA, 15 bp, Artificial Sequence
  dgRNA
  Nup133
ccaccgcggtgaatc

SEQ ID NO: 70925 - DNA, 15 bp, Artificial Sequence
  dgRNA
  Nup133
ggtgaatcgggtcgc

SEQ ID NO: 70926 - DNA, 15 bp, Artificial Sequence
  dgRNA
  Dmrt2
ctggcgggtggactc

SEQ ID NO: 70927 - DNA, 15 bp, Artificial Sequence
  dgRNA
  Dmrt2
gcgggtggactccgg

SEQ ID NO: 70928 - DNA, 15 bp, Artificial Sequence
  dgRNA
  Dmrt2
gcgcagtagcgctaa

SEQ ID NO: 70929 - DNA, 15 bp, Artificial Sequence
  dgRNA
  Dmrt2
cgcagtagcgctaaa

SEQ ID NO: 70930 - DNA, 15 bp, Artificial Sequence
  dgRNA
  Rbmx2
ctgcttgtttatacg

SEQ ID NO: 70931 - DNA, 15 bp, Artificial Sequence
  dgRNA
  Rbmx2
tgcttgtttatacgt

SEQ ID NO: 70932 - DNA, 15 bp, Artificial Sequence
  dgRNA
  Rbmx2
gcatttaattccgac

SEQ ID NO: 70933 - DNA, 15 bp, Artificial Sequence
  dgRNA
  Rbmx2
aattccgactggcag

SEQ ID NO: 70934 - DNA, 15 bp, Artificial Sequence
  dgRNA
  Med27
acatgatgaggtggt

SEQ ID NO: 70935 - DNA, 15 bp, Artificial Sequence
  dgRNA
  Med27
cctgcatcccgtgca

SEQ ID NO: 70936 - DNA, 15 bp, Artificial Sequence
  dgRNA
  Med27
atccactactcttaa

SEQ ID NO: 70937 - DNA, 15 bp, Artificial Sequence
  dgRNA
  Med27
aggtcatgcttaatc

SEQ ID NO: 70938 - DNA, 15 bp, Artificial Sequence
  dgRNA
  Sstr1
cttaacacaccactg

SEQ ID NO: 70939 - DNA, 15 bp, Artificial Sequence
  dgRNA
  Sstr1
tgctcataccgctat

SEQ ID NO: 70940 - DNA, 15 bp, Artificial Sequence
  dgRNA
  Sstr1
taccgctattggctt

SEQ ID NO: 70941 - DNA, 15 bp, Artificial Sequence
  dgRNA
  Sstr1
cgcttagtgtttgcg

SEQ ID NO: 70942 - DNA, 15 bp, Artificial Sequence
  dgRNA
  Dnaaf5
gcccgcccacttccc

SEQ ID NO: 70943 - DNA, 15 bp, Artificial Sequence
  dgRNA
  Dnaaf5
ccagcatcactccta

SEQ ID NO: 70944 - DNA, 15 bp, Artificial Sequence
  dgRNA
  Dnaaf5
cagcatcactcctaa

SEQ ID NO: 70945 - DNA, 15 bp, Artificial Sequence
  dgRNA
  Dnaaf5
agcctcgagcaaccc

SEQ ID NO: 70946 - DNA, 15 bp, Artificial Sequence
  dgRNA
  Elf1
aggacctctcggtct

SEQ ID NO: 70947 - DNA, 15 bp, Artificial Sequence
  dgRNA
  Elf1
tctcggcgtcccccc

SEQ ID NO: 70948 - DNA, 15 bp, Artificial Sequence
  dgRNA
  Elf1
ctcggcgtccccccc

SEQ ID NO: 70949 - DNA, 15 bp, Artificial Sequence
  dgRNA
  Elf1
cgtcccccccgggta

SEQ ID NO: 70950 - DNA, 15 bp, Artificial Sequence
  dgRNA
  Col22a1
tccccttctctgtcg

SEQ ID NO: 70951 - DNA, 15 bp, Artificial Sequence
  dgRNA
  Col22a1
tatcctctagggtca

SEQ ID NO: 70952 - DNA, 15 bp, Artificial Sequence
  dgRNA
  Col22a1
cctctagacacccaa

SEQ ID NO: 70953 - DNA, 15 bp, Artificial Sequence
  dgRNA
  Col22a1
ctctagacacccaaa

SEQ ID NO: 70954 - DNA, 15 bp, Artificial Sequence
  dgRNA
  Ints9
gccgctgggcatccc

SEQ ID NO: 70955 - DNA, 15 bp, Artificial Sequence
  dgRNA
  Ints9
ccgctgggcatccct

SEQ ID NO: 70956 - DNA, 15 bp, Artificial Sequence
  dgRNA
  Ints9
tttccggttccctag

SEQ ID NO: 70957 - DNA, 15 bp, Artificial Sequence
  dgRNA
  Ints9
atacgccttcccaca

SEQ ID NO: 70958 - DNA, 15 bp, Artificial Sequence
  dgRNA
  Bhmt2
gagccccgcagcgcg

SEQ ID NO: 70959 - DNA, 15 bp, Artificial Sequence
  dgRNA
  Bhmt2
cagccgcagcgcgcc

SEQ ID NO: 70960 - DNA, 15 bp, Artificial Sequence
  dgRNA
  Bhmt2
agccgcagcgcgccc

SEQ ID NO: 70961 - DNA, 15 bp, Artificial Sequence
  dgRNA
  Bhmt2
cgcagcgcgcccggg

SEQ ID NO: 70962 - DNA, 15 bp, Artificial Sequence
  dgRNA
  C330018D20Rik
tcaatgcattttagc

SEQ ID NO: 70963 - DNA, 15 bp, Artificial Sequence
  dgRNA
  C330018D20Rik
ttctattatgccagc

SEQ ID NO: 70964 - DNA, 15 bp, Artificial Sequence
  dgRNA
  C330018D20Rik
aggagcccaggcggc

SEQ ID NO: 70965 - DNA, 15 bp, Artificial Sequence
  dgRNA
  C330018D20Rik
ggagcccaggcggca

SEQ ID NO: 70966 - DNA, 15 bp, Artificial Sequence
  dgRNA
  Wdr25
gccaccggtacctct

SEQ ID NO: 70967 - DNA, 15 bp, Artificial Sequence
  dgRNA
  Wdr25
ccaccggtacctctt

SEQ ID NO: 70968 - DNA, 15 bp, Artificial Sequence
  dgRNA
  Wdr25
cctcttgggcgtccg

SEQ ID NO: 70969 - DNA, 15 bp, Artificial Sequence
  dgRNA
  Wdr25
cgtggaaacaccagc

SEQ ID NO: 70970 - DNA, 15 bp, Artificial Sequence
  dgRNA
  Rrp1
cctgctgcagtaaag

SEQ ID NO: 70971 - DNA, 15 bp, Artificial Sequence
  dgRNA
  Rrp1
tgcagttgcgcctct

SEQ ID NO: 70972 - DNA, 15 bp, Artificial Sequence
  dgRNA
  Rrp1
ctctcggccactgag

SEQ ID NO: 70973 - DNA, 15 bp, Artificial Sequence
  dgRNA
  Rrp1
tcggccactgagagg

SEQ ID NO: 70974 - DNA, 15 bp, Artificial Sequence
  dgRNA
  Gm19402
cttccggcactctcc

SEQ ID NO: 70975 - DNA, 15 bp, Artificial Sequence
  dgRNA
  Lhx3
tgactccgcctgccc

SEQ ID NO: 70976 - DNA, 15 bp, Artificial Sequence
  dgRNA
  Lhx3
aaggggccaagggcg

SEQ ID NO: 70977 - DNA, 15 bp, Artificial Sequence
  dgRNA
  Lhx3
aggtccccagcacgc

SEQ ID NO: 70978 - DNA, 15 bp, Artificial Sequence
  dgRNA
  Lhx3
ccaacttgctgtcgt

SEQ ID NO: 70979 - DNA, 15 bp, Artificial Sequence
  dgRNA
  Sprr1b
gctggaccaataagt

SEQ ID NO: 70980 - DNA, 15 bp, Artificial Sequence
  dgRNA
  Sprr1b
tgaatcatgtctgac

SEQ ID NO: 70981 - DNA, 15 bp, Artificial Sequence
  dgRNA
  Sprr1b
ctcccatttaccctc

SEQ ID NO: 70982 - DNA, 15 bp, Artificial Sequence
  dgRNA
  Sprr1b
gctccacccacttat

SEQ ID NO: 70983 - DNA, 15 bp, Artificial Sequence
  dgRNA
  Irf2
gccgccaatgaacag

SEQ ID NO: 70984 - DNA, 15 bp, Artificial Sequence
  dgRNA
  Irf2
gccaatgaacagcgg

SEQ ID NO: 70985 - DNA, 15 bp, Artificial Sequence
  dgRNA
  Irf2
aacttccgcacctcc

SEQ ID NO: 70986 - DNA, 15 bp, Artificial Sequence
  dgRNA
  Irf2
tccgcacctccaggc

SEQ ID NO: 70987 - DNA, 15 bp, Artificial Sequence
  dgRNA
  Agps
ccctttgggccaatc

SEQ ID NO: 70988 - DNA, 15 bp, Artificial Sequence
  dgRNA
  Agps
cctttgggccaatcc

SEQ ID NO: 70989 - DNA, 15 bp, Artificial Sequence
  dgRNA
  Agps
caatccgggctccgc

SEQ ID NO: 70990 - DNA, 15 bp, Artificial Sequence
  dgRNA
  Agps
ctctgcaggtacgcc

SEQ ID NO: 70991 - DNA, 15 bp, Artificial Sequence
  dgRNA
  Iba57
cgcccggggccgctg

SEQ ID NO: 70992 - DNA, 15 bp, Artificial Sequence
  dgRNA
  Iba57
caccacagcggcccc

SEQ ID NO: 70993 - DNA, 15 bp, Artificial Sequence
  dgRNA
  Iba57
aggcgggcaccacag

SEQ ID NO: 70994 - DNA, 15 bp, Artificial Sequence
  dgRNA
  Vmn1r53
gaggtagcccgacaa

SEQ ID NO: 70995 - DNA, 15 bp, Artificial Sequence
  dgRNA
  Vmn1r53
caattcagccttgat

SEQ ID NO: 70996 - DNA, 15 bp, Artificial Sequence
  dgRNA
  Vmn1r53
gtggtgctatctttg

SEQ ID NO: 70997 - DNA, 15 bp, Artificial Sequence
  dgRNA
  Vmn1r53
gtgctatctttgagg

SEQ ID NO: 70998 - DNA, 15 bp, Artificial Sequence
  dgRNA
  Vsig4
cttctgaaatacgga

SEQ ID NO: 70999 - DNA, 15 bp, Artificial Sequence
  dgRNA
  Vsig4
ctgaaatacggaagg

SEQ ID NO: 71000 - DNA, 15 bp, Artificial Sequence
  dgRNA
  Vsig4
tgaaatacggaaggt

SEQ ID NO: 71001 - DNA, 15 bp, Artificial Sequence
  dgRNA
  Vsig4
gaaatacggaaggtg

SEQ ID NO: 71002 - DNA, 15 bp, Artificial Sequence
  dgRNA
  Gmfb
aaatacctgccgtta

SEQ ID NO: 71003 - DNA, 15 bp, Artificial Sequence
  dgRNA
  Gmfb
aatctgcgcaccgct

SEQ ID NO: 71004 - DNA, 15 bp, Artificial Sequence
  dgRNA
  Gmfb
tgcgcaccgcttggc

SEQ ID NO: 71005 - DNA, 15 bp, Artificial Sequence
  dgRNA
  Gmfb
ctcattccttggtaa

SEQ ID NO: 71006 - DNA, 15 bp, Artificial Sequence
  dgRNA
  Gm14137
agcgtcctactgccc

SEQ ID NO: 71007 - DNA, 15 bp, Artificial Sequence
  dgRNA
  Gm14137
gcgtcctactgccct

SEQ ID NO: 71008 - DNA, 15 bp, Artificial Sequence
  dgRNA
  Gm14137
cgtcctactgccctg

SEQ ID NO: 71009 - DNA, 15 bp, Artificial Sequence
  dgRNA
  Gm14137
ctcagagcacgaaac

SEQ ID NO: 71010 - DNA, 15 bp, Artificial Sequence
  dgRNA
  6330416G13Rik
ggaggcttcaccgag

SEQ ID NO: 71011 - DNA, 15 bp, Artificial Sequence
  dgRNA
  6330416G13Rik
gaggcttcaccgaga

SEQ ID NO: 71012 - DNA, 15 bp, Artificial Sequence
  dgRNA
  6330416G13Rik
ggagtacagatgtca

SEQ ID NO: 71013 - DNA, 15 bp, Artificial Sequence
  dgRNA
  6330416G13Rik
aggggcgcaaccttg

SEQ ID NO: 71014 - DNA, 15 bp, Artificial Sequence
  dgRNA
  Cdcp1
ggcaacaaagtcttt

SEQ ID NO: 71015 - DNA, 15 bp, Artificial Sequence
  dgRNA
  Cdcp1
gacaaatttgcctca

SEQ ID NO: 71016 - DNA, 15 bp, Artificial Sequence
  dgRNA
  Cdcp1
caaggccaccgggca

SEQ ID NO: 71017 - DNA, 15 bp, Artificial Sequence
  dgRNA
  Cdcp1
aaggccaccgggcaa

SEQ ID NO: 71018 - DNA, 15 bp, Artificial Sequence
  dgRNA
  Plekha1
cgcgagccaccaccc

SEQ ID NO: 71019 - DNA, 15 bp, Artificial Sequence
  dgRNA
  Plekha1
tgcccgccacgccgc

SEQ ID NO: 71020 - DNA, 15 bp, Artificial Sequence
  dgRNA
  Plekha1
gcccgccacgccgcc

SEQ ID NO: 71021 - DNA, 15 bp, Artificial Sequence
  dgRNA
  Plekha1
gccgccgggcgtgcg

SEQ ID NO: 71022 - DNA, 15 bp, Artificial Sequence
  dgRNA
  Olfr884
aatgtggttgattga

SEQ ID NO: 71023 - DNA, 15 bp, Artificial Sequence
  dgRNA
  Olfr884
ttgattgatgggtgc

SEQ ID NO: 71024 - DNA, 15 bp, Artificial Sequence
  dgRNA
  Olfr884
ttcagatatgaccta

SEQ ID NO: 71025 - DNA, 15 bp, Artificial Sequence
  dgRNA
  Olfr884
atcaaccacattaat

SEQ ID NO: 71026 - DNA, 15 bp, Artificial Sequence
  dgRNA
  Ndufb2
atctgcccgttaacc

SEQ ID NO: 71027 - DNA, 15 bp, Artificial Sequence
  dgRNA
  Ndufb2
tctaaggtccgccaa

SEQ ID NO: 71028 - DNA, 15 bp, Artificial Sequence
  dgRNA
  Ndufb2
ggcctaccatcagcc

SEQ ID NO: 71029 - DNA, 15 bp, Artificial Sequence
  dgRNA
  Ndufb2
gcctaccatcagccc

SEQ ID NO: 71030 - DNA, 15 bp, Artificial Sequence
  dgRNA
  Ist1
ccggggcaaattgca

SEQ ID NO: 71031 - DNA, 15 bp, Artificial Sequence
  dgRNA
  Ist1
taagtgtcacaagtc

SEQ ID NO: 71032 - DNA, 15 bp, Artificial Sequence
  dgRNA
  Ist1
cccacgcctccgccg

SEQ ID NO: 71033 - DNA, 15 bp, Artificial Sequence
  dgRNA
  Ist1
ccacgcctccgccgt

SEQ ID NO: 71034 - DNA, 15 bp, Artificial Sequence
  dgRNA
  Akr1c12
tgctaaccatttgac

SEQ ID NO: 71035 - DNA, 15 bp, Artificial Sequence
  dgRNA
  Akr1c12
atggacaccaactca

SEQ ID NO: 71036 - DNA, 15 bp, Artificial Sequence
  dgRNA
  Akr1c12
ctatcgtctctctaa

SEQ ID NO: 71037 - DNA, 15 bp, Artificial Sequence
  dgRNA
  Prss35
ggttaaaacacgccc

SEQ ID NO: 71038 - DNA, 15 bp, Artificial Sequence
  dgRNA
  Prss35
gttaaaacacgccct

SEQ ID NO: 71039 - DNA, 15 bp, Artificial Sequence
  dgRNA
  Prss35
ctagctcttaaccat

SEQ ID NO: 71040 - DNA, 15 bp, Artificial Sequence
  dgRNA
  Prss35
ccatcggtgtgcagc

SEQ ID NO: 71041 - DNA, 15 bp, Artificial Sequence
  dgRNA
  2310057J18Rik
gtacttttggtggaa

SEQ ID NO: 71042 - DNA, 15 bp, Artificial Sequence
  dgRNA
  2310057J18Rik
gatgtacttctttac

SEQ ID NO: 71043 - DNA, 15 bp, Artificial Sequence
  dgRNA
  2310057J18Rik
gcatggtcgcacgct

SEQ ID NO: 71044 - DNA, 15 bp, Artificial Sequence
  dgRNA
  2310057J18Rik
cgaccatgcttttat

SEQ ID NO: 71045 - DNA, 15 bp, Artificial Sequence
  dgRNA
  Pts
cgaagactgaacagc

SEQ ID NO: 71046 - DNA, 15 bp, Artificial Sequence
  dgRNA
  Pts
ctccaagtcggccga

SEQ ID NO: 71047 - DNA, 15 bp, Artificial Sequence
  dgRNA
  Pts
tccaagtcggccgaa

SEQ ID NO: 71048 - DNA, 15 bp, Artificial Sequence
  dgRNA
  Pts
gtcgaaaccactccc

SEQ ID NO: 71049 - DNA, 15 bp, Artificial Sequence
  dgRNA
  Olfr1388
agataactgtatatg

SEQ ID NO: 71050 - DNA, 15 bp, Artificial Sequence
  dgRNA
  Olfr1388
gtttgcactggtcaa

SEQ ID NO: 71051 - DNA, 15 bp, Artificial Sequence
  dgRNA
  Olfr1388
tttcaacgagtagtg

SEQ ID NO: 71052 - DNA, 15 bp, Artificial Sequence
  dgRNA
  Vmn1r211
cgcagaagaaagttc

SEQ ID NO: 71053 - DNA, 15 bp, Artificial Sequence
  dgRNA
  Vmn1r211
acatttcttgggatc

SEQ ID NO: 71054 - DNA, 15 bp, Artificial Sequence
  dgRNA
  Vmn1r211
gaccttacatttctt

SEQ ID NO: 71055 - DNA, 15 bp, Artificial Sequence
  dgRNA
  Vmn1r211
atcatgataggtaag

SEQ ID NO: 71056 - DNA, 15 bp, Artificial Sequence
  dgRNA
  Ehmt2
ctcccggcggagccc

SEQ ID NO: 71057 - DNA, 15 bp, Artificial Sequence
  dgRNA
  Ehmt2
cgccctctcccctac

SEQ ID NO: 71058 - DNA, 15 bp, Artificial Sequence
  dgRNA
  Ehmt2
cctccagggccattc

SEQ ID NO: 71059 - DNA, 15 bp, Artificial Sequence
  dgRNA
  Ehmt2
ccaagaggcccgcag

SEQ ID NO: 71060 - DNA, 15 bp, Artificial Sequence
  dgRNA
  Mal
agtccatagagtcaa

SEQ ID NO: 71061 - DNA, 15 bp, Artificial Sequence
  dgRNA
  Mal
tcaaaggacacggga

SEQ ID NO: 71062 - DNA, 15 bp, Artificial Sequence
  dgRNA
  Mal
caaaggacacgggat

SEQ ID NO: 71063 - DNA, 15 bp, Artificial Sequence
  dgRNA
  Mal
tgagggaatctcccc

SEQ ID NO: 71064 - DNA, 15 bp, Artificial Sequence
  dgRNA
  Cpped1
gttggatcctgaccc

SEQ ID NO: 71065 - DNA, 15 bp, Artificial Sequence
  dgRNA
  Cpped1
ttggatcctgacccc

SEQ ID NO: 71066 - DNA, 15 bp, Artificial Sequence
  dgRNA
  Cpped1
gatcctgaccccggg

SEQ ID NO: 71067 - DNA, 15 bp, Artificial Sequence
  dgRNA
  Cpped1
cgggaggatcccact

SEQ ID NO: 71068 - DNA, 15 bp, Artificial Sequence
  dgRNA
  Serpinb6c
agaaaaatccgcagc

SEQ ID NO: 71069 - DNA, 15 bp, Artificial Sequence
  dgRNA
  Serpinb6c
aatccgcagctggat

SEQ ID NO: 71070 - DNA, 15 bp, Artificial Sequence
  dgRNA
  Serpinb6c
agctggattggcaac

SEQ ID NO: 71071 - DNA, 15 bp, Artificial Sequence
  dgRNA
  Serpinb6c
gctggattggcaacc

SEQ ID NO: 71072 - DNA, 15 bp, Artificial Sequence
  dgRNA
  Olfr371
gagtccttcacccac

SEQ ID NO: 71073 - DNA, 15 bp, Artificial Sequence
  dgRNA
  Olfr371
gccatactctcctgt

SEQ ID NO: 71074 - DNA, 15 bp, Artificial Sequence
  dgRNA
  Olfr371
gatggctgaactaag

SEQ ID NO: 71075 - DNA, 15 bp, Artificial Sequence
  dgRNA
  Adora3
gacagtttcagctac

SEQ ID NO: 71076 - DNA, 15 bp, Artificial Sequence
  dgRNA
  Adora3
gtgagatagtccaag

SEQ ID NO: 71077 - DNA, 15 bp, Artificial Sequence
  dgRNA
  Cd33
tacttgtaggaacct

SEQ ID NO: 71078 - DNA, 15 bp, Artificial Sequence
  dgRNA
  Cd33
gacgcttcctgtcat

SEQ ID NO: 71079 - DNA, 15 bp, Artificial Sequence
  dgRNA
  Cd33
tgacgcttcctgtca

SEQ ID NO: 71080 - DNA, 15 bp, Artificial Sequence
  dgRNA
  Cd33
gttcctacaagtaaa

SEQ ID NO: 71081 - DNA, 15 bp, Artificial Sequence
  dgRNA
  Iqcf3
gcagcagtcatcatt

SEQ ID NO: 71082 - DNA, 15 bp, Artificial Sequence
  dgRNA
  Iqcf3
cagcagtcatcattg

SEQ ID NO: 71083 - DNA, 15 bp, Artificial Sequence
  dgRNA
  Iqcf3
tgatccacccctggc

SEQ ID NO: 71084 - DNA, 15 bp, Artificial Sequence
  dgRNA
  Iqcf3
ggagagtaaatggtc

SEQ ID NO: 71085 - DNA, 15 bp, Artificial Sequence
  dgRNA
  Glis3
ccggcgctcacactc

SEQ ID NO: 71086 - DNA, 15 bp, Artificial Sequence
  dgRNA
  Glis3
gcgggccggccctcg

SEQ ID NO: 71087 - DNA, 15 bp, Artificial Sequence
  dgRNA
  Glis3
tccacactcctcgcc

SEQ ID NO: 71088 - DNA, 15 bp, Artificial Sequence
  dgRNA
  Glis3
tccctactgcgccgc

SEQ ID NO: 71089 - DNA, 15 bp, Artificial Sequence
  dgRNA
  Srsf4
gcgcaggcacttccg

SEQ ID NO: 71090 - DNA, 15 bp, Artificial Sequence
  dgRNA
  Srsf4
cgcaggcacttccgg

SEQ ID NO: 71091 - DNA, 15 bp, Artificial Sequence
  dgRNA
  Srsf4
gaagtgccgctgcca

SEQ ID NO: 71092 - DNA, 15 bp, Artificial Sequence
  dgRNA
  Srsf4
cggcgagctcgcgag

SEQ ID NO: 71093 - DNA, 15 bp, Artificial Sequence
  dgRNA
  Defb39
tatgcctcgtctcag

SEQ ID NO: 71094 - DNA, 15 bp, Artificial Sequence
  dgRNA
  Defb39
taagctttctaggtc

SEQ ID NO: 71095 - DNA, 15 bp, Artificial Sequence
  dgRNA
  Defb39
tttctaggtctggtc

SEQ ID NO: 71096 - DNA, 15 bp, Artificial Sequence
  dgRNA
  Defb39
ctgagacgaggcata

SEQ ID NO: 71097 - DNA, 15 bp, Artificial Sequence
  dgRNA
  Zdhhc22
accaactgtggtctc

SEQ ID NO: 71098 - DNA, 15 bp, Artificial Sequence
  dgRNA
  Zdhhc22
gcttggttccaaact

SEQ ID NO: 71099 - DNA, 15 bp, Artificial Sequence
  dgRNA
  Zdhhc22
cttggttccaaacta

SEQ ID NO: 71100 - DNA, 15 bp, Artificial Sequence
  dgRNA
  Zdhhc22
aaagggtgatccaag

SEQ ID NO: 71101 - DNA, 15 bp, Artificial Sequence
  dgRNA
  Tmem81
gagactcaagtagta

SEQ ID NO: 71102 - DNA, 15 bp, Artificial Sequence
  dgRNA
  Tmem81
tatgatgctaaagat

SEQ ID NO: 71103 - DNA, 15 bp, Artificial Sequence
  dgRNA
  Tmem81
tgttcgcatcaatga

SEQ ID NO: 71104 - DNA, 15 bp, Artificial Sequence
  dgRNA
  Bzrap1
ccagctccatcgtca

SEQ ID NO: 71105 - DNA, 15 bp, Artificial Sequence
  dgRNA
  Bzrap1
ttcctattggtgggc

SEQ ID NO: 71106 - DNA, 15 bp, Artificial Sequence
  dgRNA
  Bzrap1
gaaagctaccccctc

SEQ ID NO: 71107 - DNA, 15 bp, Artificial Sequence
  dgRNA
  Bzrap1
aggttccttactgga

SEQ ID NO: 71108 - DNA, 15 bp, Artificial Sequence
  dgRNA
  Dstn
ccgcccactccgcgc

SEQ ID NO: 71109 - DNA, 15 bp, Artificial Sequence
  dgRNA
  Dstn
cgcccactccgcgcc

SEQ ID NO: 71110 - DNA, 15 bp, Artificial Sequence
  dgRNA
  Dstn
gcccactccgcgccg

SEQ ID NO: 71111 - DNA, 15 bp, Artificial Sequence
  dgRNA
  Dstn
agcggcgcgcacacc

SEQ ID NO: 71112 - DNA, 15 bp, Artificial Sequence
  dgRNA
  Prh1
ggagttttttctagt

SEQ ID NO: 71113 - DNA, 15 bp, Artificial Sequence
  dgRNA
  Prh1
gagttttttctagta

SEQ ID NO: 71114 - DNA, 15 bp, Artificial Sequence
  dgRNA
  Stxbp6
ctaacccgcgcccca

SEQ ID NO: 71115 - DNA, 15 bp, Artificial Sequence
  dgRNA
  Stxbp6
taacccgcgccccaa

SEQ ID NO: 71116 - DNA, 15 bp, Artificial Sequence
  dgRNA
  Stxbp6
ttgtcccccgggctc

SEQ ID NO: 71117 - DNA, 15 bp, Artificial Sequence
  dgRNA
  Stxbp6
tgtcccccgggctct

SEQ ID NO: 71118 - DNA, 15 bp, Artificial Sequence
  dgRNA
  Tmbim4
tcccttgcgatgacg

SEQ ID NO: 71119 - DNA, 15 bp, Artificial Sequence
  dgRNA
  Tmbim4
cccttgcgatgacgt

SEQ ID NO: 71120 - DNA, 15 bp, Artificial Sequence
  dgRNA
  Tmbim4
aacctcctctcctag

SEQ ID NO: 71121 - DNA, 15 bp, Artificial Sequence
  dgRNA
  Tmbim4
atgggagcgatcgac

SEQ ID NO: 71122 - DNA, 15 bp, Artificial Sequence
  dgRNA
  Cntn2
gctggccaagcttga

SEQ ID NO: 71123 - DNA, 15 bp, Artificial Sequence
  dgRNA
  Cntn2
aagacggcagcgctc

SEQ ID NO: 71124 - DNA, 15 bp, Artificial Sequence
  dgRNA
  Cntn2
tctccggccgagcgt

SEQ ID NO: 71125 - DNA, 15 bp, Artificial Sequence
  dgRNA
  Cntn2
gccgagcgttggctg

SEQ ID NO: 71126 - DNA, 15 bp, Artificial Sequence
  dgRNA
  Pla2g16
gtgtataggctgtca

SEQ ID NO: 71127 - DNA, 15 bp, Artificial Sequence
  dgRNA
  Pla2g16
tgtataggctgtcaa

SEQ ID NO: 71128 - DNA, 15 bp, Artificial Sequence
  dgRNA
  Pla2g16
taggctgtcaagggc

SEQ ID NO: 71129 - DNA, 15 bp, Artificial Sequence
  dgRNA
  Pla2g16
aggcgggaacgcagc

SEQ ID NO: 71130 - DNA, 15 bp, Artificial Sequence
  dgRNA
  Cdca2
caatcagagtccggc

SEQ ID NO: 71131 - DNA, 15 bp, Artificial Sequence
  dgRNA
  Cdca2
aatcagagtccggct

SEQ ID NO: 71132 - DNA, 15 bp, Artificial Sequence
  dgRNA
  Cdca2
atcagagtccggctg

SEQ ID NO: 71133 - DNA, 15 bp, Artificial Sequence
  dgRNA
  Cdca2
tcagagtccggctgg

SEQ ID NO: 71134 - DNA, 15 bp, Artificial Sequence
  dgRNA
  2610301B20Rik
gcaaagcgggcccac

SEQ ID NO: 71135 - DNA, 15 bp, Artificial Sequence
  dgRNA
  2610301B20Rik
ggcccacaggctgcg

SEQ ID NO: 71136 - DNA, 15 bp, Artificial Sequence
  dgRNA
  2610301B20Rik
gctgcgtggacggca

SEQ ID NO: 71137 - DNA, 15 bp, Artificial Sequence
  dgRNA
  2610301B20Rik
ctgcgtggacggcaa

SEQ ID NO: 71138 - DNA, 15 bp, Artificial Sequence
  dgRNA
  Cog3
gaggtacacctcaac

SEQ ID NO: 71139 - DNA, 15 bp, Artificial Sequence
  dgRNA
  Cog3
tcaaccggaactgtt

SEQ ID NO: 71140 - DNA, 15 bp, Artificial Sequence
  dgRNA
  Cog3
aagccacgtctgttt

SEQ ID NO: 71141 - DNA, 15 bp, Artificial Sequence
  dgRNA
  Cog3
cgtctgttttggcct

SEQ ID NO: 71142 - DNA, 15 bp, Artificial Sequence
  dgRNA
  Pus7
gcatattaatagaat

SEQ ID NO: 71143 - DNA, 15 bp, Artificial Sequence
  dgRNA
  Pus7
taattgtgcttaaat

SEQ ID NO: 71144 - DNA, 15 bp, Artificial Sequence
  dgRNA
  Rhox13
cgaccgtgatacaca

SEQ ID NO: 71145 - DNA, 15 bp, Artificial Sequence
  dgRNA
  Rhox13
atgcgcacaagttcc

SEQ ID NO: 71146 - DNA, 15 bp, Artificial Sequence
  dgRNA
  Rhox13
cgtcatcgctcatcc

SEQ ID NO: 71147 - DNA, 15 bp, Artificial Sequence
  dgRNA
  Rhox13
gtcctcactttcggc

SEQ ID NO: 71148 - DNA, 15 bp, Artificial Sequence
  dgRNA
  Fmo2
tgatgaagtccttag

SEQ ID NO: 71149 - DNA, 15 bp, Artificial Sequence
  dgRNA
  Fmo2
ccttagaggtttagc

SEQ ID NO: 71150 - DNA, 15 bp, Artificial Sequence
  dgRNA
  Fmo2
ccgcacacaaccctc

SEQ ID NO: 71151 - DNA, 15 bp, Artificial Sequence
  dgRNA
  Fmo2
cgcacacaaccctca

SEQ ID NO: 71152 - DNA, 15 bp, Artificial Sequence
  dgRNA
  Cd207
cttttgactaagatt

SEQ ID NO: 71153 - DNA, 15 bp, Artificial Sequence
  dgRNA
  Cd207
cgatttgcctggcag

SEQ ID NO: 71154 - DNA, 15 bp, Artificial Sequence
  dgRNA
  Cd207
cttagacgatttgcc

SEQ ID NO: 71155 - DNA, 15 bp, Artificial Sequence
  dgRNA
  Nat2
gcccggttgcagtcc

SEQ ID NO: 71156 - DNA, 15 bp, Artificial Sequence
  dgRNA
  Nat2
ctggtagcgggtaag

SEQ ID NO: 71157 - DNA, 15 bp, Artificial Sequence
  dgRNA
  Nat2
tggtagcgggtaagt

SEQ ID NO: 71158 - DNA, 15 bp, Artificial Sequence
  dgRNA
  Nat2
ggtagcgggtaagtg

SEQ ID NO: 71159 - DNA, 15 bp, Artificial Sequence
  dgRNA
  Tango6
atgcgcatgagttgc

SEQ ID NO: 71160 - DNA, 15 bp, Artificial Sequence
  dgRNA
  Tango6
tggacctgagtttgc

SEQ ID NO: 71161 - DNA, 15 bp, Artificial Sequence
  dgRNA
  Tango6
tgaactggggcgctc

SEQ ID NO: 71162 - DNA, 15 bp, Artificial Sequence
  dgRNA
  Tango6
gaactggggcgctct

SEQ ID NO: 71163 - DNA, 15 bp, Artificial Sequence
  dgRNA
  Idua
cagccgcaagaataa

SEQ ID NO: 71164 - DNA, 15 bp, Artificial Sequence
  dgRNA
  Idua
aagcactgctaatgt

SEQ ID NO: 71165 - DNA, 15 bp, Artificial Sequence
  dgRNA
  Idua
catttttggagcgcc

SEQ ID NO: 71166 - DNA, 15 bp, Artificial Sequence
  dgRNA
  Idua
atttttggagcgcct

SEQ ID NO: 71167 - DNA, 15 bp, Artificial Sequence
  dgRNA
  Mucl2
tgttacacacctacc

SEQ ID NO: 71168 - DNA, 15 bp, Artificial Sequence
  dgRNA
  Mucl2
acacctaccaggttg

SEQ ID NO: 71169 - DNA, 15 bp, Artificial Sequence
  dgRNA
  Mucl2
tggtaggtgtgtaac

SEQ ID NO: 71170 - DNA, 15 bp, Artificial Sequence
  dgRNA
  Mucl2
ctgccacaacctggt

SEQ ID NO: 71171 - DNA, 15 bp, Artificial Sequence
  dgRNA
  Orai2
gcccacgacagatgc

SEQ ID NO: 71172 - DNA, 15 bp, Artificial Sequence
  dgRNA
  Orai2
cccacgacagatgct

SEQ ID NO: 71173 - DNA, 15 bp, Artificial Sequence
  dgRNA
  Orai2
ctagtgtcactcgct

SEQ ID NO: 71174 - DNA, 15 bp, Artificial Sequence
  dgRNA
  Orai2
gcgctctcccacgcc

SEQ ID NO: 71175 - DNA, 15 bp, Artificial Sequence
  dgRNA
  AI413582
ccgcccgtgtgcagc

SEQ ID NO: 71176 - DNA, 15 bp, Artificial Sequence
  dgRNA
  AI413582
cgcccgtgtgcagcc

SEQ ID NO: 71177 - DNA, 15 bp, Artificial Sequence
  dgRNA
  AI413582
aaccttcccgctgcg

SEQ ID NO: 71178 - DNA, 15 bp, Artificial Sequence
  dgRNA
  AI413582
ccgctgcgcggccct

SEQ ID NO: 71179 - DNA, 15 bp, Artificial Sequence
  dgRNA
  Nrd1
cgccccgcccacgtc

SEQ ID NO: 71180 - DNA, 15 bp, Artificial Sequence
  dgRNA
  Nrd1
tttcgaaatgctctc

SEQ ID NO: 71181 - DNA, 15 bp, Artificial Sequence
  dgRNA
  Nrd1
ttcgaaatgctctct

SEQ ID NO: 71182 - DNA, 15 bp, Artificial Sequence
  dgRNA
  Nrd1
ctctctgggtgcgcc

SEQ ID NO: 71183 - DNA, 15 bp, Artificial Sequence
  dgRNA
  Slurp1
ccaaaaggtccatag

SEQ ID NO: 71184 - DNA, 15 bp, Artificial Sequence
  dgRNA
  Slurp1
caaaaggtccataga

SEQ ID NO: 71185 - DNA, 15 bp, Artificial Sequence
  dgRNA
  Slurp1
aaaaggtccatagag

SEQ ID NO: 71186 - DNA, 15 bp, Artificial Sequence
  dgRNA
  Slurp1
agaagccgaagccgg

SEQ ID NO: 71187 - DNA, 15 bp, Artificial Sequence
  dgRNA
  Ivns1abp
acgtggtgacgtgcg

SEQ ID NO: 71188 - DNA, 15 bp, Artificial Sequence
  dgRNA
  Ivns1abp
cgtggtgacgtgcga

SEQ ID NO: 71189 - DNA, 15 bp, Artificial Sequence
  dgRNA
  Vwa2
ccgcaccgcttgcag

SEQ ID NO: 71190 - DNA, 15 bp, Artificial Sequence
  dgRNA
  Vwa2
ccgcttgcagcggcc

SEQ ID NO: 71191 - DNA, 15 bp, Artificial Sequence
  dgRNA
  Vwa2
agcggccaggtcgct

SEQ ID NO: 71192 - DNA, 15 bp, Artificial Sequence
  dgRNA
  Vwa2
gatgctgcggtccgt

SEQ ID NO: 71193 - DNA, 15 bp, Artificial Sequence
  dgRNA
  St8sia1
aatctgtgcatactc

SEQ ID NO: 71194 - DNA, 15 bp, Artificial Sequence
  dgRNA
  St8sia1
atctgtgcatactcc

SEQ ID NO: 71195 - DNA, 15 bp, Artificial Sequence
  dgRNA
  St8sia1
gcatgcacgcaccag

SEQ ID NO: 71196 - DNA, 15 bp, Artificial Sequence
  dgRNA
  St8sia1
catgcacgcaccaga

SEQ ID NO: 71197 - DNA, 15 bp, Artificial Sequence
  dgRNA
  Gpr18
cagcccgagatgagc

SEQ ID NO: 71198 - DNA, 15 bp, Artificial Sequence
  dgRNA
  Gpr18
agcgtttcctgaaaa

SEQ ID NO: 71199 - DNA, 15 bp, Artificial Sequence
  dgRNA
  Gpr18
actttaccctggatg

SEQ ID NO: 71200 - DNA, 15 bp, Artificial Sequence
  dgRNA
  Gpr18
cgtgggactttaccc

SEQ ID NO: 71201 - DNA, 15 bp, Artificial Sequence
  dgRNA
  Cx3cr1
atgcaggctctcttg

SEQ ID NO: 71202 - DNA, 15 bp, Artificial Sequence
  dgRNA
  Cx3cr1
tctcttgcggtcagc

SEQ ID NO: 71203 - DNA, 15 bp, Artificial Sequence
  dgRNA
  Cx3cr1
gatagggtaccacac

SEQ ID NO: 71204 - DNA, 15 bp, Artificial Sequence
  dgRNA
  Cx3cr1
gatgccctcatagag

SEQ ID NO: 71205 - DNA, 15 bp, Artificial Sequence
  dgRNA
  Foxi3
gtcgcccagcctccc

SEQ ID NO: 71206 - DNA, 15 bp, Artificial Sequence
  dgRNA
  Foxi3
caggtataagagacg

SEQ ID NO: 71207 - DNA, 15 bp, Artificial Sequence
  dgRNA
  Foxi3
cggtacccccgccct

SEQ ID NO: 71208 - DNA, 15 bp, Artificial Sequence
  dgRNA
  Foxi3
ctcagcgctccaagt

SEQ ID NO: 71209 - DNA, 15 bp, Artificial Sequence
  dgRNA
  Olfr1393
ttatctatctaaagt

SEQ ID NO: 71210 - DNA, 15 bp, Artificial Sequence
  dgRNA
  Olfr1393
tatctatctaaagta

SEQ ID NO: 71211 - DNA, 15 bp, Artificial Sequence
  dgRNA
  Olfr1393
aacaaactcgtgttt

SEQ ID NO: 71212 - DNA, 15 bp, Artificial Sequence
  dgRNA
  Olfr1393
acaaactcgtgtttt

SEQ ID NO: 71213 - DNA, 15 bp, Artificial Sequence
  dgRNA
  Ccnd1
tttgcatatctacga

SEQ ID NO: 71214 - DNA, 15 bp, Artificial Sequence
  dgRNA
  Ccnd1
tatctacgaaggctg

SEQ ID NO: 71215 - DNA, 15 bp, Artificial Sequence
  dgRNA
  Ccnd1
atctacgaaggctga

SEQ ID NO: 71216 - DNA, 15 bp, Artificial Sequence
  dgRNA
  Ccnd1
tctacgaaggctgag

SEQ ID NO: 71217 - DNA, 15 bp, Artificial Sequence
  dgRNA
  Nle1
gaaaagaaggcgcga

SEQ ID NO: 71218 - DNA, 15 bp, Artificial Sequence
  dgRNA
  Nle1
aaaagaaggcgcgaa

SEQ ID NO: 71219 - DNA, 15 bp, Artificial Sequence
  dgRNA
  Nle1
agaaggcgcgaaggg

SEQ ID NO: 71220 - DNA, 15 bp, Artificial Sequence
  dgRNA
  Nle1
caccattggcaatcc

SEQ ID NO: 71221 - DNA, 15 bp, Artificial Sequence
  dgRNA
  Gng4
ccccactctgcactt

SEQ ID NO: 71222 - DNA, 15 bp, Artificial Sequence
  dgRNA
  Gng4
cccactctgcacttg

SEQ ID NO: 71223 - DNA, 15 bp, Artificial Sequence
  dgRNA
  Gng4
gccataaaccctcca

SEQ ID NO: 71224 - DNA, 15 bp, Artificial Sequence
  dgRNA
  Gng4
aggctgcgcactccc

SEQ ID NO: 71225 - DNA, 15 bp, Artificial Sequence
  dgRNA
  Pebp4
cagccttagaatcct

SEQ ID NO: 71226 - DNA, 15 bp, Artificial Sequence
  dgRNA
  Pebp4
ggctgcgtcctccca

SEQ ID NO: 71227 - DNA, 15 bp, Artificial Sequence
  dgRNA
  Prmt6
ctcgggaaaatagtg

SEQ ID NO: 71228 - DNA, 15 bp, Artificial Sequence
  dgRNA
  Prmt6
ttgtcatggcgttag

SEQ ID NO: 71229 - DNA, 15 bp, Artificial Sequence
  dgRNA
  Prmt6
tgccaagattgactc

SEQ ID NO: 71230 - DNA, 15 bp, Artificial Sequence
  dgRNA
  Prmt6
actacgaatcccagc

SEQ ID NO: 71231 - DNA, 15 bp, Artificial Sequence
  dgRNA
  Plpp4
tgacgcgcccctgat

SEQ ID NO: 71232 - DNA, 15 bp, Artificial Sequence
  dgRNA
  Plpp4
ctgatcggcgttatc

SEQ ID NO: 71233 - DNA, 15 bp, Artificial Sequence
  dgRNA
  Plpp4
cggcgttatcaggag

SEQ ID NO: 71234 - DNA, 15 bp, Artificial Sequence
  dgRNA
  Plpp4
ggcgttatcaggagt

SEQ ID NO: 71235 - DNA, 15 bp, Artificial Sequence
  dgRNA
  Vmn1r213
ggttgttatgctcta

SEQ ID NO: 71236 - DNA, 15 bp, Artificial Sequence
  dgRNA
  Vmn1r213
aggttgttatgctct

SEQ ID NO: 71237 - DNA, 15 bp, Artificial Sequence
  dgRNA
  Sbds
ttactcacccataat

SEQ ID NO: 71238 - DNA, 15 bp, Artificial Sequence
  dgRNA
  Sbds
ataggtaggcgtaac

SEQ ID NO: 71239 - DNA, 15 bp, Artificial Sequence
  dgRNA
  Sbds
cccgccttcctttga

SEQ ID NO: 71240 - DNA, 15 bp, Artificial Sequence
  dgRNA
  Sbds
gggcgtaaaaagtca

SEQ ID NO: 71241 - DNA, 15 bp, Artificial Sequence
  dgRNA
  Olfr713
tatgaccgtgccgtt

SEQ ID NO: 71242 - DNA, 15 bp, Artificial Sequence
  dgRNA
  Olfr713
gtgccgttaggtatt

SEQ ID NO: 71243 - DNA, 15 bp, Artificial Sequence
  dgRNA
  Olfr713
ccctgccaattatca

SEQ ID NO: 71244 - DNA, 15 bp, Artificial Sequence
  dgRNA
  Olfr713
cctgccaattatcaa

SEQ ID NO: 71245 - DNA, 15 bp, Artificial Sequence
  dgRNA
  Isoc2b
aaggccctccctccg

SEQ ID NO: 71246 - DNA, 15 bp, Artificial Sequence
  dgRNA
  Isoc2b
accaatcgaattaac

SEQ ID NO: 71247 - DNA, 15 bp, Artificial Sequence
  dgRNA
  Isoc2b
atcgaattaacagga

SEQ ID NO: 71248 - DNA, 15 bp, Artificial Sequence
  dgRNA
  Isoc2b
gaggcgaacgccgat

SEQ ID NO: 71249 - DNA, 15 bp, Artificial Sequence
  dgRNA
  Slain1
cggaagaagtgcgag

SEQ ID NO: 71250 - DNA, 15 bp, Artificial Sequence
  dgRNA
  Slain1
agaagtgcgagcggc

SEQ ID NO: 71251 - DNA, 15 bp, Artificial Sequence
  dgRNA
  Slain1
agcggcgggaagttc

SEQ ID NO: 71252 - DNA, 15 bp, Artificial Sequence
  dgRNA
  Slain1
cgggaagttcaggcc

SEQ ID NO: 71253 - DNA, 15 bp, Artificial Sequence
  dgRNA
  Cetn3
cgcttccgccccaat

SEQ ID NO: 71254 - DNA, 15 bp, Artificial Sequence
  dgRNA
  Cetn3
tccgccccaataggc

SEQ ID NO: 71255 - DNA, 15 bp, Artificial Sequence
  dgRNA
  Cetn3
caataggccggctgt

SEQ ID NO: 71256 - DNA, 15 bp, Artificial Sequence
  dgRNA
  Cetn3
gcccagaaacttgtc

SEQ ID NO: 71257 - DNA, 15 bp, Artificial Sequence
  dgRNA
  Krt1
cgtaaaaatcttgta

SEQ ID NO: 71258 - DNA, 15 bp, Artificial Sequence
  dgRNA
  Krt1
ataagggcacggcac

SEQ ID NO: 71259 - DNA, 15 bp, Artificial Sequence
  dgRNA
  Krt1
taagggcacggcact

SEQ ID NO: 71260 - DNA, 15 bp, Artificial Sequence
  dgRNA
  Krt1
caagaatggctcgtg

SEQ ID NO: 71261 - DNA, 15 bp, Artificial Sequence
  dgRNA
  Trappc6a
ggatgtccgaagact

SEQ ID NO: 71262 - DNA, 15 bp, Artificial Sequence
  dgRNA
  Trappc6a
gatgtccgaagactc

SEQ ID NO: 71263 - DNA, 15 bp, Artificial Sequence
  dgRNA
  Trappc6a
cgaagactcgggagc

SEQ ID NO: 71264 - DNA, 15 bp, Artificial Sequence
  dgRNA
  Trappc6a
aagatgttaacagcg

SEQ ID NO: 71265 - DNA, 15 bp, Artificial Sequence
  dgRNA
  Sec23a
gccctccgctttgct

SEQ ID NO: 71266 - DNA, 15 bp, Artificial Sequence
  dgRNA
  Sec23a
gcgccccgcctcttc

SEQ ID NO: 71267 - DNA, 15 bp, Artificial Sequence
  dgRNA
  Sec23a
cgccccgcctcttcc

SEQ ID NO: 71268 - DNA, 15 bp, Artificial Sequence
  dgRNA
  Sec23a
ttcccgccccttcgc

SEQ ID NO: 71269 - DNA, 15 bp, Artificial Sequence
  dgRNA
  Kcnc2
tgaaaggcggtagcg

SEQ ID NO: 71270 - DNA, 15 bp, Artificial Sequence
  dgRNA
  Kcnc2
gaacagagcgggcaa

SEQ ID NO: 71271 - DNA, 15 bp, Artificial Sequence
  dgRNA
  Kcnc2
aacagagcgggcaaa

SEQ ID NO: 71272 - DNA, 15 bp, Artificial Sequence
  dgRNA
  Kcnc2
gcactcccctagtgc

SEQ ID NO: 71273 - DNA, 15 bp, Artificial Sequence
  dgRNA
  Krt15
agttggctccgctca

SEQ ID NO: 71274 - DNA, 15 bp, Artificial Sequence
  dgRNA
  Krt15
gttggctccgctcaa

SEQ ID NO: 71275 - DNA, 15 bp, Artificial Sequence
  dgRNA
  Krt15
ttggctccgctcaag

SEQ ID NO: 71276 - DNA, 15 bp, Artificial Sequence
  dgRNA
  Krt15
gctccgctcaagggg

SEQ ID NO: 71277 - DNA, 15 bp, Artificial Sequence
  dgRNA
  Gm438
tcagattattcttag

SEQ ID NO: 71278 - DNA, 15 bp, Artificial Sequence
  dgRNA
  Gm438
gattgtgtcagaggg

SEQ ID NO: 71279 - DNA, 15 bp, Artificial Sequence
  dgRNA
  Gm438
cagtaaaactggatc

SEQ ID NO: 71280 - DNA, 15 bp, Artificial Sequence
  dgRNA
  Zcchc14
ccggtccgcaggggg

SEQ ID NO: 71281 - DNA, 15 bp, Artificial Sequence
  dgRNA
  Zcchc14
cggtccgcagggggc

SEQ ID NO: 71282 - DNA, 15 bp, Artificial Sequence
  dgRNA
  Zcchc14
cttcgaccaatccta

SEQ ID NO: 71283 - DNA, 15 bp, Artificial Sequence
  dgRNA
  Zcchc14
aacgagccgtcgcgc

SEQ ID NO: 71284 - DNA, 15 bp, Artificial Sequence
  dgRNA
  Paxbp1
ggctgccacacgtaa

SEQ ID NO: 71285 - DNA, 15 bp, Artificial Sequence
  dgRNA
  Paxbp1
ggctccgtataagcg

SEQ ID NO: 71286 - DNA, 15 bp, Artificial Sequence
  dgRNA
  Paxbp1
aacactggagtcgga

SEQ ID NO: 71287 - DNA, 15 bp, Artificial Sequence
  dgRNA
  Paxbp1
cccccgcgccgctag

SEQ ID NO: 71288 - DNA, 15 bp, Artificial Sequence
  dgRNA
  Krtap14
tattacctgaattcc

SEQ ID NO: 71289 - DNA, 15 bp, Artificial Sequence
  dgRNA
  Krtap14
attacctgaattcca

SEQ ID NO: 71290 - DNA, 15 bp, Artificial Sequence
  dgRNA
  Krtap14
taaatatgcgtgact

SEQ ID NO: 71291 - DNA, 15 bp, Artificial Sequence
  dgRNA
  Krtap14
tatgcgtgactagga

SEQ ID NO: 71292 - DNA, 15 bp, Artificial Sequence
  dgRNA
  Krtap12-1
tcccctggggccatt

SEQ ID NO: 71293 - DNA, 15 bp, Artificial Sequence
  dgRNA
  Ampd3
acccagtgctaactt

SEQ ID NO: 71294 - DNA, 15 bp, Artificial Sequence
  dgRNA
  Ampd3
gaaggcgtggtcagc

SEQ ID NO: 71295 - DNA, 15 bp, Artificial Sequence
  dgRNA
  Ampd3
acagaaagctcccgc

SEQ ID NO: 71296 - DNA, 15 bp, Artificial Sequence
  dgRNA
  Ampd3
tcattccggactttg

SEQ ID NO: 71297 - DNA, 15 bp, Artificial Sequence
  dgRNA
  Rsph9
cttcccaagtccgta

SEQ ID NO: 71298 - DNA, 15 bp, Artificial Sequence
  dgRNA
  Rsph9
ttcccaagtccgtat

SEQ ID NO: 71299 - DNA, 15 bp, Artificial Sequence
  dgRNA
  Rsph9
ccgtatgggcaaaaa

SEQ ID NO: 71300 - DNA, 15 bp, Artificial Sequence
  dgRNA
  Rsph9
atggagtacgtaatg

SEQ ID NO: 71301 - DNA, 15 bp, Artificial Sequence
  dgRNA
  Nudt21
accagcattacccaa

SEQ ID NO: 71302 - DNA, 15 bp, Artificial Sequence
  dgRNA
  Nudt21
cattacccaatggaa

SEQ ID NO: 71303 - DNA, 15 bp, Artificial Sequence
  dgRNA
  Nudt21
cacgccgccagcaat

SEQ ID NO: 71304 - DNA, 15 bp, Artificial Sequence
  dgRNA
  Nudt21
cagcaattggtcaaa

SEQ ID NO: 71305 - DNA, 15 bp, Artificial Sequence
  dgRNA
  Glb1l
gctcgagcccacctc

SEQ ID NO: 71306 - DNA, 15 bp, Artificial Sequence
  dgRNA
  Glb1l
ccaccctccgtcgct

SEQ ID NO: 71307 - DNA, 15 bp, Artificial Sequence
  dgRNA
  Glb1l
ctcgggaacgagcac

SEQ ID NO: 71308 - DNA, 15 bp, Artificial Sequence
  dgRNA
  Glb1l
tcgggaacgagcaca

SEQ ID NO: 71309 - DNA, 15 bp, Artificial Sequence
  dgRNA
  Akt2
aagccctttgattgc

SEQ ID NO: 71310 - DNA, 15 bp, Artificial Sequence
  dgRNA
  Akt2
ccgggaagtaatcac

SEQ ID NO: 71311 - DNA, 15 bp, Artificial Sequence
  dgRNA
  Akt2
cgggaagtaatcact

SEQ ID NO: 71312 - DNA, 15 bp, Artificial Sequence
  dgRNA
  Akt2
aatcactgggccttc

SEQ ID NO: 71313 - DNA, 15 bp, Artificial Sequence
  dgRNA
  Ptprn2
ctatcccccgcgagg

SEQ ID NO: 71314 - DNA, 15 bp, Artificial Sequence
  dgRNA
  Ptprn2
tatcccccgcgaggt

SEQ ID NO: 71315 - DNA, 15 bp, Artificial Sequence
  dgRNA
  Ptprn2
gtgcctgaacgtgca

SEQ ID NO: 71316 - DNA, 15 bp, Artificial Sequence
  dgRNA
  Ptprn2
agagggcgtggtcat

SEQ ID NO: 71317 - DNA, 15 bp, Artificial Sequence
  dgRNA
  Fam20b
ggagaaatccgccga

SEQ ID NO: 71318 - DNA, 15 bp, Artificial Sequence
  dgRNA
  Fam20b
cgccgacggtgtctg

SEQ ID NO: 71319 - DNA, 15 bp, Artificial Sequence
  dgRNA
  Fam20b
gcgctgcaggaatga

SEQ ID NO: 71320 - DNA, 15 bp, Artificial Sequence
  dgRNA
  Fam20b
ttaaagggggcggtc

SEQ ID NO: 71321 - DNA, 15 bp, Artificial Sequence
  dgRNA
  Zfp827
cccgacattagtgtt

SEQ ID NO: 71322 - DNA, 15 bp, Artificial Sequence
  dgRNA
  Zfp827
ccgacattagtgtta

SEQ ID NO: 71323 - DNA, 15 bp, Artificial Sequence
  dgRNA
  Zfp827
cggagacacagcgcg

SEQ ID NO: 71324 - DNA, 15 bp, Artificial Sequence
  dgRNA
  Zfp827
tagacaccgccgcac

SEQ ID NO: 71325 - DNA, 15 bp, Artificial Sequence
  dgRNA
  Calu
cagcagtgatcgtgc

SEQ ID NO: 71326 - DNA, 15 bp, Artificial Sequence
  dgRNA
  Calu
agcagtgatcgtgcc

SEQ ID NO: 71327 - DNA, 15 bp, Artificial Sequence
  dgRNA
  Calu
gcagtgatcgtgccg

SEQ ID NO: 71328 - DNA, 15 bp, Artificial Sequence
  dgRNA
  Calu
agacccccgacaagt

SEQ ID NO: 71329 - DNA, 15 bp, Artificial Sequence
  dgRNA
  Lhpp
ttgaactccttccgc

SEQ ID NO: 71330 - DNA, 15 bp, Artificial Sequence
  dgRNA
  Lhpp
tgatagtcaagcgtc

SEQ ID NO: 71331 - DNA, 15 bp, Artificial Sequence
  dgRNA
  Lhpp
agtcaagcgtcaggc

SEQ ID NO: 71332 - DNA, 15 bp, Artificial Sequence
  dgRNA
  Lhpp
tcaggctggtccacg

SEQ ID NO: 71333 - DNA, 15 bp, Artificial Sequence
  dgRNA
  Sncaip
tgcggggaagagcca

SEQ ID NO: 71334 - DNA, 15 bp, Artificial Sequence
  dgRNA
  Sncaip
ttggctcttccccgc

SEQ ID NO: 71335 - DNA, 15 bp, Artificial Sequence
  dgRNA
  Pop7
ttgcgcacgcgcacg

SEQ ID NO: 71336 - DNA, 15 bp, Artificial Sequence
  dgRNA
  Pop7
cacgcgcacgaggaa

SEQ ID NO: 71337 - DNA, 15 bp, Artificial Sequence
  dgRNA
  Pop7
gcgcacgaggaaagg

SEQ ID NO: 71338 - DNA, 15 bp, Artificial Sequence
  dgRNA
  Pop7
aggccataagcttat

SEQ ID NO: 71339 - DNA, 15 bp, Artificial Sequence
  dgRNA
  Casp4
gaagtgataaaattc

SEQ ID NO: 71340 - DNA, 15 bp, Artificial Sequence
  dgRNA
  Casp4
cgcctccctatgcta

SEQ ID NO: 71341 - DNA, 15 bp, Artificial Sequence
  dgRNA
  Casp4
ttatcacttcgtcat

SEQ ID NO: 71342 - DNA, 15 bp, Artificial Sequence
  dgRNA
  Casp4
tttatcacttcgtca

SEQ ID NO: 71343 - DNA, 15 bp, Artificial Sequence
  dgRNA
  Gbgt1
ctttgctccgcccca

SEQ ID NO: 71344 - DNA, 15 bp, Artificial Sequence
  dgRNA
  Gbgt1
tccgccccaaggacc

SEQ ID NO: 71345 - DNA, 15 bp, Artificial Sequence
  dgRNA
  Gbgt1
gagcaaagtaagtct

SEQ ID NO: 71346 - DNA, 15 bp, Artificial Sequence
  dgRNA
  Gbgt1
ggagcaaagtaagtc

SEQ ID NO: 71347 - DNA, 15 bp, Artificial Sequence
  dgRNA
  Fam212b
atgaatgcacttgac

SEQ ID NO: 71348 - DNA, 15 bp, Artificial Sequence
  dgRNA
  Fam212b
tgaatgcacttgact

SEQ ID NO: 71349 - DNA, 15 bp, Artificial Sequence
  dgRNA
  Fam212b
gaatgcacttgactg

SEQ ID NO: 71350 - DNA, 15 bp, Artificial Sequence
  dgRNA
  Fam212b
aatgcacttgactgg

SEQ ID NO: 71351 - DNA, 15 bp, Artificial Sequence
  dgRNA
  Adra2b
tccacccaccctggt

SEQ ID NO: 71352 - DNA, 15 bp, Artificial Sequence
  dgRNA
  Adra2b
ctcctcccgcggtgc

SEQ ID NO: 71353 - DNA, 15 bp, Artificial Sequence
  dgRNA
  Adra2b
cctcacgcccctgcg

SEQ ID NO: 71354 - DNA, 15 bp, Artificial Sequence
  dgRNA
  Adra2b
cacgcccctgcgcgg

SEQ ID NO: 71355 - DNA, 15 bp, Artificial Sequence
  dgRNA
  Slitrk2
gcagcggctcctttg

SEQ ID NO: 71356 - DNA, 15 bp, Artificial Sequence
  dgRNA
  Slitrk2
cagcggctcctttgt

SEQ ID NO: 71357 - DNA, 15 bp, Artificial Sequence
  dgRNA
  Slitrk2
tcccgagtgcacagc

SEQ ID NO: 71358 - DNA, 15 bp, Artificial Sequence
  dgRNA
  Slitrk2
cccgagtgcacagca

SEQ ID NO: 71359 - DNA, 15 bp, Artificial Sequence
  dgRNA
  Rnf44
cacggtccccgtacc

SEQ ID NO: 71360 - DNA, 15 bp, Artificial Sequence
  dgRNA
  Rnf44
acggtccccgtacct

SEQ ID NO: 71361 - DNA, 15 bp, Artificial Sequence
  dgRNA
  Rnf44
tcatcacctgcgact

SEQ ID NO: 71362 - DNA, 15 bp, Artificial Sequence
  dgRNA
  Rnf44
tgcgactcggccttg

SEQ ID NO: 71363 - DNA, 15 bp, Artificial Sequence
  dgRNA
  Slc26a4
ggagggtaagattcg

SEQ ID NO: 71364 - DNA, 15 bp, Artificial Sequence
  dgRNA
  Slc26a4
gagggtaagattcgt

SEQ ID NO: 71365 - DNA, 15 bp, Artificial Sequence
  dgRNA
  Slc26a4
agggtaagattcgtg

SEQ ID NO: 71366 - DNA, 15 bp, Artificial Sequence
  dgRNA
  Slc26a4
acagggacaccacga

SEQ ID NO: 71367 - DNA, 15 bp, Artificial Sequence
  dgRNA
  Olfr1511
ggcaatgtttatatc

SEQ ID NO: 71368 - DNA, 15 bp, Artificial Sequence
  dgRNA
  Clec4b2
ctcatgagagttttc

SEQ ID NO: 71369 - DNA, 15 bp, Artificial Sequence
  dgRNA
  Clec4b2
gttgagttcctaatg

SEQ ID NO: 71370 - DNA, 15 bp, Artificial Sequence
  dgRNA
  Lax1
actcttcaaccacat

SEQ ID NO: 71371 - DNA, 15 bp, Artificial Sequence
  dgRNA
  Lax1
gccttattagcacac

SEQ ID NO: 71372 - DNA, 15 bp, Artificial Sequence
  dgRNA
  Lax1
ttattagcacaccgg

SEQ ID NO: 71373 - DNA, 15 bp, Artificial Sequence
  dgRNA
  Lax1
ttagcacaccggtgg

SEQ ID NO: 71374 - DNA, 15 bp, Artificial Sequence
  dgRNA
  Gp6
ttcttgccagctgta

SEQ ID NO: 71375 - DNA, 15 bp, Artificial Sequence
  dgRNA
  Gp6
ggtcatctcctcagt

SEQ ID NO: 71376 - DNA, 15 bp, Artificial Sequence
  dgRNA
  Gp6
aacaggatgcgctga

SEQ ID NO: 71377 - DNA, 15 bp, Artificial Sequence
  dgRNA
  Gp6
gaacaggatgcgctg

SEQ ID NO: 71378 - DNA, 15 bp, Artificial Sequence
  dgRNA
  Tmc6
ctgttttggatgggc

SEQ ID NO: 71379 - DNA, 15 bp, Artificial Sequence
  dgRNA
  Tmc6
atgggcgggtcctac

SEQ ID NO: 71380 - DNA, 15 bp, Artificial Sequence
  dgRNA
  Tmc6
gcgggtcctaccggt

SEQ ID NO: 71381 - DNA, 15 bp, Artificial Sequence
  dgRNA
  Tmc6
gtcctaccggtaggc

SEQ ID NO: 71382 - DNA, 15 bp, Artificial Sequence
  dgRNA
  Kntc1
ggttagtctctcgaa

SEQ ID NO: 71383 - DNA, 15 bp, Artificial Sequence
  dgRNA
  Kntc1
gtctctcgaagggcg

SEQ ID NO: 71384 - DNA, 15 bp, Artificial Sequence
  dgRNA
  Kntc1
gtgaagcctacgaag

SEQ ID NO: 71385 - DNA, 15 bp, Artificial Sequence
  dgRNA
  Kntc1
agcctacgaagtggg

SEQ ID NO: 71386 - DNA, 15 bp, Artificial Sequence
  dgRNA
  Maz
tcgcccccacccagg

SEQ ID NO: 71387 - DNA, 15 bp, Artificial Sequence
  dgRNA
  Maz
ctccctcccgccggc

SEQ ID NO: 71388 - DNA, 15 bp, Artificial Sequence
  dgRNA
  Maz
tccctcccgccggcc

SEQ ID NO: 71389 - DNA, 15 bp, Artificial Sequence
  dgRNA
  Maz
ccctcccgccggccg

SEQ ID NO: 71390 - DNA, 15 bp, Artificial Sequence
  dgRNA
  Ncapd3
ctgcctggactcccg

SEQ ID NO: 71391 - DNA, 15 bp, Artificial Sequence
  dgRNA
  Ncapd3
cgcaccgaagtgcta

SEQ ID NO: 71392 - DNA, 15 bp, Artificial Sequence
  dgRNA
  Ncapd3
accgaagtgctacgg

SEQ ID NO: 71393 - DNA, 15 bp, Artificial Sequence
  dgRNA
  Ncapd3
gtgctacggcggcgc

SEQ ID NO: 71394 - DNA, 15 bp, Artificial Sequence
  dgRNA
  Ggnbp2
gccgatttcgaaagt

SEQ ID NO: 71395 - DNA, 15 bp, Artificial Sequence
  dgRNA
  Ggnbp2
ccgatttcgaaagtc

SEQ ID NO: 71396 - DNA, 15 bp, Artificial Sequence
  dgRNA
  Ggnbp2
gtcgggacacgagcg

SEQ ID NO: 71397 - DNA, 15 bp, Artificial Sequence
  dgRNA
  Ggnbp2
gggacacgagcgagg

SEQ ID NO: 71398 - DNA, 15 bp, Artificial Sequence
  dgRNA
  Sec62
taatagtcatatagc

SEQ ID NO: 71399 - DNA, 15 bp, Artificial Sequence
  dgRNA
  Sec62
atagtcatatagaag

SEQ ID NO: 71400 - DNA, 15 bp, Artificial Sequence
  dgRNA
  Sec62
ccaccttaacttccc

SEQ ID NO: 71401 - DNA, 15 bp, Artificial Sequence
  dgRNA
  Sec62
gtgaggtgtcacgtg

SEQ ID NO: 71402 - DNA, 15 bp, Artificial Sequence
  dgRNA
  Prkaca
tcgcccgcccgactg

SEQ ID NO: 71403 - DNA, 15 bp, Artificial Sequence
  dgRNA
  Prkaca
tcacgagcccgtgag

SEQ ID NO: 71404 - DNA, 15 bp, Artificial Sequence
  dgRNA
  Prkaca
cgagcccgtgagtgg

SEQ ID NO: 71405 - DNA, 15 bp, Artificial Sequence
  dgRNA
  Prkaca
tcgcgtcactcatcc

SEQ ID NO: 71406 - DNA, 15 bp, Artificial Sequence
  dgRNA
  Gpalpp1
cggcgcagcttcgct

SEQ ID NO: 71407 - DNA, 15 bp, Artificial Sequence
  dgRNA
  Gpalpp1
cttcgctcggagtcc

SEQ ID NO: 71408 - DNA, 15 bp, Artificial Sequence
  dgRNA
  Gpalpp1
ttcgctcggagtccc

SEQ ID NO: 71409 - DNA, 15 bp, Artificial Sequence
  dgRNA
  Gpalpp1
tcggagtcccgggcg

SEQ ID NO: 71410 - DNA, 15 bp, Artificial Sequence
  dgRNA
  Tmem132c
tgggtctccctcccg

SEQ ID NO: 71411 - DNA, 15 bp, Artificial Sequence
  dgRNA
  Tmem132c
ccgaggcctgcgctc

SEQ ID NO: 71412 - DNA, 15 bp, Artificial Sequence
  dgRNA
  Tmem132c
cgaggcctgcgctcc

SEQ ID NO: 71413 - DNA, 15 bp, Artificial Sequence
  dgRNA
  Tmem132c
ctccgggaacctctc

SEQ ID NO: 71414 - DNA, 15 bp, Artificial Sequence
  dgRNA
  Trim14
aaggatgctgtgccg

SEQ ID NO: 71415 - DNA, 15 bp, Artificial Sequence
  dgRNA
  Trim14
cgcggatccagcact

SEQ ID NO: 71416 - DNA, 15 bp, Artificial Sequence
  dgRNA
  Trim14
ggatccagcactagg

SEQ ID NO: 71417 - DNA, 15 bp, Artificial Sequence
  dgRNA
  Trim14
gatccagcactaggt

SEQ ID NO: 71418 - DNA, 15 bp, Artificial Sequence
  dgRNA
  Olfr27
gattgtcttggcaat

SEQ ID NO: 71419 - DNA, 15 bp, Artificial Sequence
  dgRNA
  Cenpf
atccgacgtctgcgc

SEQ ID NO: 71420 - DNA, 15 bp, Artificial Sequence
  dgRNA
  Cenpf
cgcaggctccgccgc

SEQ ID NO: 71421 - DNA, 15 bp, Artificial Sequence
  dgRNA
  Cenpf
aaacagtcgtccaaa

SEQ ID NO: 71422 - DNA, 15 bp, Artificial Sequence
  dgRNA
  Cenpf
aacagtcgtccaaaa

SEQ ID NO: 71423 - DNA, 15 bp, Artificial Sequence
  dgRNA
  Slc25a42
tctccgccttgtacc

SEQ ID NO: 71424 - DNA, 15 bp, Artificial Sequence
  dgRNA
  Slc25a42
ccttcctttagcgat

SEQ ID NO: 71425 - DNA, 15 bp, Artificial Sequence
  dgRNA
  Slc25a42
agcgattggttaaaa

SEQ ID NO: 71426 - DNA, 15 bp, Artificial Sequence
  dgRNA
  Slc25a42
gtctccagcgctgat

SEQ ID NO: 71427 - DNA, 15 bp, Artificial Sequence
  dgRNA
  S100a6
gccgcagcattagtc

SEQ ID NO: 71428 - DNA, 15 bp, Artificial Sequence
  dgRNA
  S100a6
ggaccttgccactag

SEQ ID NO: 71429 - DNA, 15 bp, Artificial Sequence
  dgRNA
  S100a6
gaccttgccactaga

SEQ ID NO: 71430 - DNA, 15 bp, Artificial Sequence
  dgRNA
  S100a6
acactgctctcgggc

SEQ ID NO: 71431 - DNA, 15 bp, Artificial Sequence
  dgRNA
  Jmjd1c
taccggccgcctgag

SEQ ID NO: 71432 - DNA, 15 bp, Artificial Sequence
  dgRNA
  Jmjd1c
tgtgggccgcgcgtg

SEQ ID NO: 71433 - DNA, 15 bp, Artificial Sequence
  dgRNA
  Jmjd1c
ccgcgcgtgaggtcg

SEQ ID NO: 71434 - DNA, 15 bp, Artificial Sequence
  dgRNA
  Jmjd1c
cgcgcgtgaggtcgt

SEQ ID NO: 71435 - DNA, 15 bp, Artificial Sequence
  dgRNA
  BC048546
ctgccgactccagcc

SEQ ID NO: 71436 - DNA, 15 bp, Artificial Sequence
  dgRNA
  BC048546
ccagcgaactttagc

SEQ ID NO: 71437 - DNA, 15 bp, Artificial Sequence
  dgRNA
  BC048546
taaaccgataccccc

SEQ ID NO: 71438 - DNA, 15 bp, Artificial Sequence
  dgRNA
  BC048546
cgataccccctggcg

SEQ ID NO: 71439 - DNA, 15 bp, Artificial Sequence
  dgRNA
  Fus
gcgagccccgggcga

SEQ ID NO: 71440 - DNA, 15 bp, Artificial Sequence
  dgRNA
  Fus
gagccaccggccgca

SEQ ID NO: 71441 - DNA, 15 bp, Artificial Sequence
  dgRNA
  Fus
gcgcgtgcgagtgtt

SEQ ID NO: 71442 - DNA, 15 bp, Artificial Sequence
  dgRNA
  Fus
cgcgtgcgagtgttt

SEQ ID NO: 71443 - DNA, 15 bp, Artificial Sequence
  dgRNA
  Pold2
cgcccagcctcacta

SEQ ID NO: 71444 - DNA, 15 bp, Artificial Sequence
  dgRNA
  Pold2
ggcccacgctaccca

SEQ ID NO: 71445 - DNA, 15 bp, Artificial Sequence
  dgRNA
  Pold2
ggagttcacccgatg

SEQ ID NO: 71446 - DNA, 15 bp, Artificial Sequence
  dgRNA
  Pold2
acaccgcatgcgcac

SEQ ID NO: 71447 - DNA, 15 bp, Artificial Sequence
  dgRNA
  Defb23
aacacaatatatcta

SEQ ID NO: 71448 - DNA, 15 bp, Artificial Sequence
  dgRNA
  Defb23
ttattggcctcttca

SEQ ID NO: 71449 - DNA, 15 bp, Artificial Sequence
  dgRNA
  Olfr1137
gcactaatacaacac

SEQ ID NO: 71450 - DNA, 15 bp, Artificial Sequence
  dgRNA
  Olfr1137
aattagtccagaaat

SEQ ID NO: 71451 - DNA, 15 bp, Artificial Sequence
  dgRNA
  Olfr1137
gcataataccatttt

SEQ ID NO: 71452 - DNA, 15 bp, Artificial Sequence
  dgRNA
  Olfr1137
gtgttgtattagtgc

SEQ ID NO: 71453 - DNA, 15 bp, Artificial Sequence
  dgRNA
  Rnf103
tcttgactggggccg

SEQ ID NO: 71454 - DNA, 15 bp, Artificial Sequence
  dgRNA
  Rnf103
gggccgcggctacag

SEQ ID NO: 71455 - DNA, 15 bp, Artificial Sequence
  dgRNA
  Rnf103
ggccgcggctacagc

SEQ ID NO: 71456 - DNA, 15 bp, Artificial Sequence
  dgRNA
  Rnf103
gacccgctgtagccg

SEQ ID NO: 71457 - DNA, 15 bp, Artificial Sequence
  dgRNA
  Spin4
tgggaatgaaccggc

SEQ ID NO: 71458 - DNA, 15 bp, Artificial Sequence
  dgRNA
  Spin4
gggaatgaaccggct

SEQ ID NO: 71459 - DNA, 15 bp, Artificial Sequence
  dgRNA
  Spin4
aatgaaccggctggg

SEQ ID NO: 71460 - DNA, 15 bp, Artificial Sequence
  dgRNA
  Spin4
ccggctggggggcca

SEQ ID NO: 71461 - DNA, 15 bp, Artificial Sequence
  dgRNA
  Acaa2
ggtgtgcggtcgaag

SEQ ID NO: 71462 - DNA, 15 bp, Artificial Sequence
  dgRNA
  Acaa2
ggcgcggggcacacg

SEQ ID NO: 71463 - DNA, 15 bp, Artificial Sequence
  dgRNA
  Acaa2
acacgtggcccgaag

SEQ ID NO: 71464 - DNA, 15 bp, Artificial Sequence
  dgRNA
  Acaa2
cacgtggcccgaagt

SEQ ID NO: 71465 - DNA, 15 bp, Artificial Sequence
  dgRNA
  Slc26a5
accatagtatatacc

SEQ ID NO: 71466 - DNA, 15 bp, Artificial Sequence
  dgRNA
  Slc26a5
tcaacccgtattttc

SEQ ID NO: 71467 - DNA, 15 bp, Artificial Sequence
  dgRNA
  Prdm4
tctccacacgcagag

SEQ ID NO: 71468 - DNA, 15 bp, Artificial Sequence
  dgRNA
  Prdm4
ggcggtgcgtatccc

SEQ ID NO: 71469 - DNA, 15 bp, Artificial Sequence
  dgRNA
  Prdm4
gtatccccggaagag

SEQ ID NO: 71470 - DNA, 15 bp, Artificial Sequence
  dgRNA
  Prdm4
tatccccggaagagc

SEQ ID NO: 71471 - DNA, 15 bp, Artificial Sequence
  dgRNA
  Kdelc2
tcaggcaactagtgt

SEQ ID NO: 71472 - DNA, 15 bp, Artificial Sequence
  dgRNA
  Kdelc2
atgactaggagcgta

SEQ ID NO: 71473 - DNA, 15 bp, Artificial Sequence
  dgRNA
  Kdelc2
taggagcgtaaggcc

SEQ ID NO: 71474 - DNA, 15 bp, Artificial Sequence
  dgRNA
  Kdelc2
aggagcgtaaggcct

SEQ ID NO: 71475 - DNA, 15 bp, Artificial Sequence
  dgRNA
  Glb1l2
ataaacctcagccaa

SEQ ID NO: 71476 - DNA, 15 bp, Artificial Sequence
  dgRNA
  Glb1l2
taaacctcagccaat

SEQ ID NO: 71477 - DNA, 15 bp, Artificial Sequence
  dgRNA
  Glb1l2
gccaatgggcgccag

SEQ ID NO: 71478 - DNA, 15 bp, Artificial Sequence
  dgRNA
  Glb1l2
ccaatgggcgccagt

SEQ ID NO: 71479 - DNA, 15 bp, Artificial Sequence
  dgRNA
  Pgm2l1
cgggtgtacagaact

SEQ ID NO: 71480 - DNA, 15 bp, Artificial Sequence
  dgRNA
  Pgm2l1
gggtgtacagaactc

SEQ ID NO: 71481 - DNA, 15 bp, Artificial Sequence
  dgRNA
  Pgm2l1
ggtgtacagaactcg

SEQ ID NO: 71482 - DNA, 15 bp, Artificial Sequence
  dgRNA
  Pgm2l1
gaactcggggaaccg

SEQ ID NO: 71483 - DNA, 15 bp, Artificial Sequence
  dgRNA
  Gdi1
acctacttagagtag

SEQ ID NO: 71484 - DNA, 15 bp, Artificial Sequence
  dgRNA
  Gdi1
gcttgttacttttcc

SEQ ID NO: 71485 - DNA, 15 bp, Artificial Sequence
  dgRNA
  Gdi1
gtttctcccaggggg

SEQ ID NO: 71486 - DNA, 15 bp, Artificial Sequence
  dgRNA
  Gdi1
tcccagggggcggta

SEQ ID NO: 71487 - DNA, 15 bp, Artificial Sequence
  dgRNA
  Olfr1162
ttaaacagtgccatt

SEQ ID NO: 71488 - DNA, 15 bp, Artificial Sequence
  dgRNA
  Gm13023
gcggctgactttagc

SEQ ID NO: 71489 - DNA, 15 bp, Artificial Sequence
  dgRNA
  Gm13023
cggctgactttagct

SEQ ID NO: 71490 - DNA, 15 bp, Artificial Sequence
  dgRNA
  Gm13023
atattgattcatagc

SEQ ID NO: 71491 - DNA, 15 bp, Artificial Sequence
  dgRNA
  Gm13023
tattgattcatagca

SEQ ID NO: 71492 - DNA, 15 bp, Artificial Sequence
  dgRNA
  Hsd17b11
ttttaggaaagcgtg

SEQ ID NO: 71493 - DNA, 15 bp, Artificial Sequence
  dgRNA
  Hsd17b11
actagccctcctagg

SEQ ID NO: 71494 - DNA, 15 bp, Artificial Sequence
  dgRNA
  Hsd17b11
tccgcgatagctatc

SEQ ID NO: 71495 - DNA, 15 bp, Artificial Sequence
  dgRNA
  Hsd17b11
ccgcgatagctatca

SEQ ID NO: 71496 - DNA, 15 bp, Artificial Sequence
  dgRNA
  Bpifb1
tgcaagatataaggc

SEQ ID NO: 71497 - DNA, 15 bp, Artificial Sequence
  dgRNA
  Bpifb1
gcaagatataaggct

SEQ ID NO: 71498 - DNA, 15 bp, Artificial Sequence
  dgRNA
  Bpifb1
gtgggccaagacctc

SEQ ID NO: 71499 - DNA, 15 bp, Artificial Sequence
  dgRNA
  Olfr283
ccggtgctcccaaga

SEQ ID NO: 71500 - DNA, 15 bp, Artificial Sequence
  dgRNA
  Olfr283
ccaagaaggtatctc

SEQ ID NO: 71501 - DNA, 15 bp, Artificial Sequence
  dgRNA
  Olfr283
tatctccggagctag

SEQ ID NO: 71502 - DNA, 15 bp, Artificial Sequence
  dgRNA
  Olfr283
cggagataccttctt

SEQ ID NO: 71503 - DNA, 15 bp, Artificial Sequence
  dgRNA
  Vps13c
ccccccccgcaatcg

SEQ ID NO: 71504 - DNA, 15 bp, Artificial Sequence
  dgRNA
  Vps13c
cccccgcaatcgcgg

SEQ ID NO: 71505 - DNA, 15 bp, Artificial Sequence
  dgRNA
  Vps13c
ccgcaatcgcggagg

SEQ ID NO: 71506 - DNA, 15 bp, Artificial Sequence
  dgRNA
  Vps13c
cgcaatcgcggaggt

SEQ ID NO: 71507 - DNA, 15 bp, Artificial Sequence
  dgRNA
  Mcpt1
tcatactctgaccac

SEQ ID NO: 71508 - DNA, 15 bp, Artificial Sequence
  dgRNA
  Slc46a2
gctgctctaggttcg

SEQ ID NO: 71509 - DNA, 15 bp, Artificial Sequence
  dgRNA
  Slc46a2
ctgctctaggttcgt

SEQ ID NO: 71510 - DNA, 15 bp, Artificial Sequence
  dgRNA
  Slc46a2
tgctctaggttcgtg

SEQ ID NO: 71511 - DNA, 15 bp, Artificial Sequence
  dgRNA
  Slc46a2
tctaggttcgtgggg

SEQ ID NO: 71512 - DNA, 15 bp, Artificial Sequence
  dgRNA
  Dcaf10
ctgctggttgtagtc

SEQ ID NO: 71513 - DNA, 15 bp, Artificial Sequence
  dgRNA
  Dcaf10
agtcctcctaggttg

SEQ ID NO: 71514 - DNA, 15 bp, Artificial Sequence
  dgRNA
  Dcaf10
aggttgtggcgcacc

SEQ ID NO: 71515 - DNA, 15 bp, Artificial Sequence
  dgRNA
  Dcaf10
ttgtggcgcacccgg

SEQ ID NO: 71516 - DNA, 15 bp, Artificial Sequence
  dgRNA
  Pnpo
tgctcccgcccctgg

SEQ ID NO: 71517 - DNA, 15 bp, Artificial Sequence
  dgRNA
  Pnpo
ggaggcgctgcccat

SEQ ID NO: 71518 - DNA, 15 bp, Artificial Sequence
  dgRNA
  Pnpo
cattcccgctctaat

SEQ ID NO: 71519 - DNA, 15 bp, Artificial Sequence
  dgRNA
  Pnpo
aattggtctcgctcc

SEQ ID NO: 71520 - DNA, 15 bp, Artificial Sequence
  dgRNA
  Zfp738
gtcccgtcccttgtg

SEQ ID NO: 71521 - DNA, 15 bp, Artificial Sequence
  dgRNA
  Zfp738
gacctcacaagggac

SEQ ID NO: 71522 - DNA, 15 bp, Artificial Sequence
  dgRNA
  Zfp738
gaagctcgattccga

SEQ ID NO: 71523 - DNA, 15 bp, Artificial Sequence
  dgRNA
  Zfp738
ggaagctcgattccg

SEQ ID NO: 71524 - DNA, 15 bp, Artificial Sequence
  dgRNA
  Braf
aaacgtgtgagcgcg

SEQ ID NO: 71525 - DNA, 15 bp, Artificial Sequence
  dgRNA
  Braf
aacgtgtgagcgcga

SEQ ID NO: 71526 - DNA, 15 bp, Artificial Sequence
  dgRNA
  Braf
gtgtgagcgcgaggg

SEQ ID NO: 71527 - DNA, 15 bp, Artificial Sequence
  dgRNA
  Braf
gagcgcgagggtggt

SEQ ID NO: 71528 - DNA, 15 bp, Artificial Sequence
  dgRNA
  Vgll3
tcccgagctcgctcc

SEQ ID NO: 71529 - DNA, 15 bp, Artificial Sequence
  dgRNA
  Vgll3
agctcgctcccggcg

SEQ ID NO: 71530 - DNA, 15 bp, Artificial Sequence
  dgRNA
  Vgll3
agcccgaggccgccg

SEQ ID NO: 71531 - DNA, 15 bp, Artificial Sequence
  dgRNA
  Vgll3
gctggttcagcgacg

SEQ ID NO: 71532 - DNA, 15 bp, Artificial Sequence
  dgRNA
  Ankfn1
gcctcagtgacaccg

SEQ ID NO: 71533 - DNA, 15 bp, Artificial Sequence
  dgRNA
  Ankfn1
gaacaatcaatgatt

SEQ ID NO: 71534 - DNA, 15 bp, Artificial Sequence
  dgRNA
  Ankfn1
gaaacggtatgatcc

SEQ ID NO: 71535 - DNA, 15 bp, Artificial Sequence
  dgRNA
  Ankfn1
tcacaggatcctagc

SEQ ID NO: 71536 - DNA, 15 bp, Artificial Sequence
  dgRNA
  Eps15l1
aaaacttctcacggg

SEQ ID NO: 71537 - DNA, 15 bp, Artificial Sequence
  dgRNA
  Eps15l1
tctcacgggaggact

SEQ ID NO: 71538 - DNA, 15 bp, Artificial Sequence
  dgRNA
  Eps15l1
tgcgcacgtgtactc

SEQ ID NO: 71539 - DNA, 15 bp, Artificial Sequence
  dgRNA
  Eps15l1
ggcctgtccttgcgc

SEQ ID NO: 71540 - DNA, 15 bp, Artificial Sequence
  dgRNA
  8430408G22Rik
agacagctttactat

SEQ ID NO: 71541 - DNA, 15 bp, Artificial Sequence
  dgRNA
  8430408G22Rik
tagacagctttacta

SEQ ID NO: 71542 - DNA, 15 bp, Artificial Sequence
  dgRNA
  Lin9
agcgaccaggaaccc

SEQ ID NO: 71543 - DNA, 15 bp, Artificial Sequence
  dgRNA
  Lin9
cgtccgccgcgccac

SEQ ID NO: 71544 - DNA, 15 bp, Artificial Sequence
  dgRNA
  Lin9
gccgcgccaccggcc

SEQ ID NO: 71545 - DNA, 15 bp, Artificial Sequence
  dgRNA
  Lin9
ccgcgccaccggccc

SEQ ID NO: 71546 - DNA, 15 bp, Artificial Sequence
  dgRNA
  Fbxw5
gtgagtcagaacgct

SEQ ID NO: 71547 - DNA, 15 bp, Artificial Sequence
  dgRNA
  Fbxw5
agtaagagtttgcgc

SEQ ID NO: 71548 - DNA, 15 bp, Artificial Sequence
  dgRNA
  Fbxw5
gcgcataagaaacgc

SEQ ID NO: 71549 - DNA, 15 bp, Artificial Sequence
  dgRNA
  Fbxw5
acgctggctgctagt

SEQ ID NO: 71550 - DNA, 15 bp, Artificial Sequence
  dgRNA
  Astn1
ggatgctgctgcgac

SEQ ID NO: 71551 - DNA, 15 bp, Artificial Sequence
  dgRNA
  Astn1
gcatcatcaaccagc

SEQ ID NO: 71552 - DNA, 15 bp, Artificial Sequence
  dgRNA
  Astn1
tcatcaaccagctgg

SEQ ID NO: 71553 - DNA, 15 bp, Artificial Sequence
  dgRNA
  Paip1
cgccgctcgtccaag

SEQ ID NO: 71554 - DNA, 15 bp, Artificial Sequence
  dgRNA
  Paip1
cgctcgtccaagcgg

SEQ ID NO: 71555 - DNA, 15 bp, Artificial Sequence
  dgRNA
  Paip1
gctcgtccaagcggc

SEQ ID NO: 71556 - DNA, 15 bp, Artificial Sequence
  dgRNA
  Paip1
ctcgtccaagcggcg

SEQ ID NO: 71557 - DNA, 15 bp, Artificial Sequence
  dgRNA
  Eif3b
ctcgggctgatcgtg

SEQ ID NO: 71558 - DNA, 15 bp, Artificial Sequence
  dgRNA
  Eif3b
tgatcgtgaggaatg

SEQ ID NO: 71559 - DNA, 15 bp, Artificial Sequence
  dgRNA
  Eif3b
gatcgtgaggaatga

SEQ ID NO: 71560 - DNA, 15 bp, Artificial Sequence
  dgRNA
  Eif3b
ccccgagccacatct

SEQ ID NO: 71561 - DNA, 15 bp, Artificial Sequence
  dgRNA
  Ephx3
ctagggctccgccca

SEQ ID NO: 71562 - DNA, 15 bp, Artificial Sequence
  dgRNA
  Ephx3
gcaacctccgaaacc

SEQ ID NO: 71563 - DNA, 15 bp, Artificial Sequence
  dgRNA
  Ephx3
aaaccaggtcctcgc

SEQ ID NO: 71564 - DNA, 15 bp, Artificial Sequence
  dgRNA
  Ephx3
tgtctcgttctgccc

SEQ ID NO: 71565 - DNA, 15 bp, Artificial Sequence
  dgRNA
  Mei1
acgcacagtcctttt

SEQ ID NO: 71566 - DNA, 15 bp, Artificial Sequence
  dgRNA
  Mei1
tgcgtggacctcatc

SEQ ID NO: 71567 - DNA, 15 bp, Artificial Sequence
  dgRNA
  Mei1
gcaactaaacccaaa

SEQ ID NO: 71568 - DNA, 15 bp, Artificial Sequence
  dgRNA
  Mbd5
ccgctctcccagagg

SEQ ID NO: 71569 - DNA, 15 bp, Artificial Sequence
  dgRNA
  Mbd5
cgctctcccagagga

SEQ ID NO: 71570 - DNA, 15 bp, Artificial Sequence
  dgRNA
  Mbd5
accccctgcttacaa

SEQ ID NO: 71571 - DNA, 15 bp, Artificial Sequence
  dgRNA
  Mbd5
gcttacaatggcttc

SEQ ID NO: 71572 - DNA, 15 bp, Artificial Sequence
  dgRNA
  Snx6
cagcgactatcgctc

SEQ ID NO: 71573 - DNA, 15 bp, Artificial Sequence
  dgRNA
  Snx6
agcgactatcgctct

SEQ ID NO: 71574 - DNA, 15 bp, Artificial Sequence
  dgRNA
  Snx6
cgtcctttccccttc

SEQ ID NO: 71575 - DNA, 15 bp, Artificial Sequence
  dgRNA
  Snx6
ctccccctcctagag

SEQ ID NO: 71576 - DNA, 15 bp, Artificial Sequence
  dgRNA
  Podnl1
tggctcggctcaggc

SEQ ID NO: 71577 - DNA, 15 bp, Artificial Sequence
  dgRNA
  Podnl1
cggcctgccctcttc

SEQ ID NO: 71578 - DNA, 15 bp, Artificial Sequence
  dgRNA
  Podnl1
cttctcaggccccgc

SEQ ID NO: 71579 - DNA, 15 bp, Artificial Sequence
  dgRNA
  Podnl1
ttctcaggccccgcg

SEQ ID NO: 71580 - DNA, 15 bp, Artificial Sequence
  dgRNA
  Dcdc2a
ctggatgcttcgggg

SEQ ID NO: 71581 - DNA, 15 bp, Artificial Sequence
  dgRNA
  Dcdc2a
tggatgcttcggggc

SEQ ID NO: 71582 - DNA, 15 bp, Artificial Sequence
  dgRNA
  Dcdc2a
ggatgcttcggggcg

SEQ ID NO: 71583 - DNA, 15 bp, Artificial Sequence
  dgRNA
  Dcdc2a
cctgcgagcgctgat

SEQ ID NO: 71584 - DNA, 15 bp, Artificial Sequence
  dgRNA
  Brdt
gggtgagtcccataa

SEQ ID NO: 71585 - DNA, 15 bp, Artificial Sequence
  dgRNA
  Ahrr
tacccgaagagcaag

SEQ ID NO: 71586 - DNA, 15 bp, Artificial Sequence
  dgRNA
  Ahrr
ggtgacaccctatcc

SEQ ID NO: 71587 - DNA, 15 bp, Artificial Sequence
  dgRNA
  Ahrr
aggcactcagacccg

SEQ ID NO: 71588 - DNA, 15 bp, Artificial Sequence
  dgRNA
  Ahrr
tattgaaagggcgcg

SEQ ID NO: 71589 - DNA, 15 bp, Artificial Sequence
  dgRNA
  Ankrd66
tgatgcaggaaccta

SEQ ID NO: 71590 - DNA, 15 bp, Artificial Sequence
  dgRNA
  Ankrd66
tagggagcactaact

SEQ ID NO: 71591 - DNA, 15 bp, Artificial Sequence
  dgRNA
  Ankrd66
gggagcactaactag

SEQ ID NO: 71592 - DNA, 15 bp, Artificial Sequence
  dgRNA
  Ankrd66
tagttagtgctccct

SEQ ID NO: 71593 - DNA, 15 bp, Artificial Sequence
  dgRNA
  Clhc1
tctcacgggtgtcgt

SEQ ID NO: 71594 - DNA, 15 bp, Artificial Sequence
  dgRNA
  Nub1
tctgtcaaggctttt

SEQ ID NO: 71595 - DNA, 15 bp, Artificial Sequence
  dgRNA
  Nub1
ctgaaaaactcggtc

SEQ ID NO: 71596 - DNA, 15 bp, Artificial Sequence
  dgRNA
  Nub1
tgaaaaactcggtct

SEQ ID NO: 71597 - DNA, 15 bp, Artificial Sequence
  dgRNA
  Nub1
aactcggtctgggag

SEQ ID NO: 71598 - DNA, 15 bp, Artificial Sequence
  dgRNA
  Xndc1
gcaggagagcgttct

SEQ ID NO: 71599 - DNA, 15 bp, Artificial Sequence
  dgRNA
  Xndc1
caccagtccgcactg

SEQ ID NO: 71600 - DNA, 15 bp, Artificial Sequence
  dgRNA
  Xndc1
gtccgcactgtggag

SEQ ID NO: 71601 - DNA, 15 bp, Artificial Sequence
  dgRNA
  Xndc1
gacactccctcgctt

SEQ ID NO: 71602 - DNA, 15 bp, Artificial Sequence
  dgRNA
  Wap
agtcctttgtaaggg

SEQ ID NO: 71603 - DNA, 15 bp, Artificial Sequence
  dgRNA
  Wap
ggcacagctctagat

SEQ ID NO: 71604 - DNA, 15 bp, Artificial Sequence
  dgRNA
  Wap
taaaggacccacagg

SEQ ID NO: 71605 - DNA, 15 bp, Artificial Sequence
  dgRNA
  Wap
atttaaaggacccac

SEQ ID NO: 71606 - DNA, 15 bp, Artificial Sequence
  dgRNA
  Olfr1441
caaagactattatct

SEQ ID NO: 71607 - DNA, 15 bp, Artificial Sequence
  dgRNA
  Olfr1441
gacctccacacgttg

SEQ ID NO: 71608 - DNA, 15 bp, Artificial Sequence
  dgRNA
  Olfr1441
ctccacacgttgtgg

SEQ ID NO: 71609 - DNA, 15 bp, Artificial Sequence
  dgRNA
  Olfr1441
ccacacgttgtggag

SEQ ID NO: 71610 - DNA, 15 bp, Artificial Sequence
  dgRNA
  Itm2a
cagtaggagcatgcc

SEQ ID NO: 71611 - DNA, 15 bp, Artificial Sequence
  dgRNA
  Itm2a
atgtctaccctaagc

SEQ ID NO: 71612 - DNA, 15 bp, Artificial Sequence
  dgRNA
  Itm2a
ctgatggccggctta

SEQ ID NO: 71613 - DNA, 15 bp, Artificial Sequence
  dgRNA
  Itm2a
gctgatggccggctt

SEQ ID NO: 71614 - DNA, 15 bp, Artificial Sequence
  dgRNA
  Mepce
tccccgcccctagag

SEQ ID NO: 71615 - DNA, 15 bp, Artificial Sequence
  dgRNA
  Mepce
ccgcccctagagcgg

SEQ ID NO: 71616 - DNA, 15 bp, Artificial Sequence
  dgRNA
  Mepce
cgcccctagagcgga

SEQ ID NO: 71617 - DNA, 15 bp, Artificial Sequence
  dgRNA
  Mepce
gcccctagagcggag

SEQ ID NO: 71618 - DNA, 15 bp, Artificial Sequence
  dgRNA
  Cldn16
tggctcgtctgtcta

SEQ ID NO: 71619 - DNA, 15 bp, Artificial Sequence
  dgRNA
  Cldn16
ctgtctaaggtagtt

SEQ ID NO: 71620 - DNA, 15 bp, Artificial Sequence
  dgRNA
  Cldn16
tgtctaaggtagtta

SEQ ID NO: 71621 - DNA, 15 bp, Artificial Sequence
  dgRNA
  Cldn16
gtctaaggtagttag

SEQ ID NO: 71622 - DNA, 15 bp, Artificial Sequence
  dgRNA
  Crygn
cataggactgattat

SEQ ID NO: 71623 - DNA, 15 bp, Artificial Sequence
  dgRNA
  Crygn
cagcaagcaacgagc

SEQ ID NO: 71624 - DNA, 15 bp, Artificial Sequence
  dgRNA
  Crygn
agcaacgagctggac

SEQ ID NO: 71625 - DNA, 15 bp, Artificial Sequence
  dgRNA
  Crygn
gaggcattgaggact

SEQ ID NO: 71626 - DNA, 15 bp, Artificial Sequence
  dgRNA
  Slc38a6
gttttctacatcacc

SEQ ID NO: 71627 - DNA, 15 bp, Artificial Sequence
  dgRNA
  Slc38a6
ggccagcgtcacccg

SEQ ID NO: 71628 - DNA, 15 bp, Artificial Sequence
  dgRNA
  Slc38a6
agcgtcacccgaggc

SEQ ID NO: 71629 - DNA, 15 bp, Artificial Sequence
  dgRNA
  Slc38a6
gtgcagctcggaaat

SEQ ID NO: 71630 - DNA, 15 bp, Artificial Sequence
  dgRNA
  Rhox3g
tcgatgtgattatct

SEQ ID NO: 71631 - DNA, 15 bp, Artificial Sequence
  dgRNA
  Lonrf3
caatttccccgctgc

SEQ ID NO: 71632 - DNA, 15 bp, Artificial Sequence
  dgRNA
  Lonrf3
gggtcctttctggac

SEQ ID NO: 71633 - DNA, 15 bp, Artificial Sequence
  dgRNA
  Lonrf3
attttgggtcctttc

SEQ ID NO: 71634 - DNA, 15 bp, Artificial Sequence
  dgRNA
  Lonrf3
tgcgcttgcttcttt

SEQ ID NO: 71635 - DNA, 15 bp, Artificial Sequence
  dgRNA
  Rabgap1l
cctggcaaaatagcc

SEQ ID NO: 71636 - DNA, 15 bp, Artificial Sequence
  dgRNA
  Rabgap1l
aaagcaattcaatcc

SEQ ID NO: 71637 - DNA, 15 bp, Artificial Sequence
  dgRNA
  Klhl36
gcactccgccttcac

SEQ ID NO: 71638 - DNA, 15 bp, Artificial Sequence
  dgRNA
  Klhl36
cctgcccctcaggcg

SEQ ID NO: 71639 - DNA, 15 bp, Artificial Sequence
  dgRNA
  Klhl36
ctttcgcccgcctgc

SEQ ID NO: 71640 - DNA, 15 bp, Artificial Sequence
  dgRNA
  Klhl36
cgccattgacagtgt

SEQ ID NO: 71641 - DNA, 15 bp, Artificial Sequence
  dgRNA
  Spdl1
caaaagcccaagtcg

SEQ ID NO: 71642 - DNA, 15 bp, Artificial Sequence
  dgRNA
  Spdl1
cccactcgtttgccc

SEQ ID NO: 71643 - DNA, 15 bp, Artificial Sequence
  dgRNA
  Spdl1
actcgtttgccccgg

SEQ ID NO: 71644 - DNA, 15 bp, Artificial Sequence
  dgRNA
  Spdl1
tttgccccggaggcg

SEQ ID NO: 71645 - DNA, 15 bp, Artificial Sequence
  dgRNA
  Grcc10
catagcctttacaag

SEQ ID NO: 71646 - DNA, 15 bp, Artificial Sequence
  dgRNA
  Grcc10
aactcaagaaacgag

SEQ ID NO: 71647 - DNA, 15 bp, Artificial Sequence
  dgRNA
  Grcc10
ttatcgaaccgaata

SEQ ID NO: 71648 - DNA, 15 bp, Artificial Sequence
  dgRNA
  Grcc10
gcgagattaaaggct

SEQ ID NO: 71649 - DNA, 15 bp, Artificial Sequence
  dgRNA
  Ccdc58
gtctcaccagccgcc

SEQ ID NO: 71650 - DNA, 15 bp, Artificial Sequence
  dgRNA
  Ccdc58
ccagccgccaggcgc

SEQ ID NO: 71651 - DNA, 15 bp, Artificial Sequence
  dgRNA
  Ccdc58
aggcgcaggccgccg

SEQ ID NO: 71652 - DNA, 15 bp, Artificial Sequence
  dgRNA
  Ccdc58
cgccgaggctccaca

SEQ ID NO: 71653 - DNA, 15 bp, Artificial Sequence
  dgRNA
  Adamts12
ttggcccgcatgccc

SEQ ID NO: 71654 - DNA, 15 bp, Artificial Sequence
  dgRNA
  Adamts12
ggctctgagcccgga

SEQ ID NO: 71655 - DNA, 15 bp, Artificial Sequence
  dgRNA
  Adamts12
gtgttagctggctgg

SEQ ID NO: 71656 - DNA, 15 bp, Artificial Sequence
  dgRNA
  Adamts12
tggaggcctgtcggg

SEQ ID NO: 71657 - DNA, 15 bp, Artificial Sequence
  dgRNA
  Tmem69
agcctctcgcctgag

SEQ ID NO: 71658 - DNA, 15 bp, Artificial Sequence
  dgRNA
  Tmem69
gcctctcgcctgagt

SEQ ID NO: 71659 - DNA, 15 bp, Artificial Sequence
  dgRNA
  Tmem69
ccgttaattcccatc

SEQ ID NO: 71660 - DNA, 15 bp, Artificial Sequence
  dgRNA
  Tmem69
gattccccacagtat

SEQ ID NO: 71661 - DNA, 15 bp, Artificial Sequence
  dgRNA
  Atf7ip2
tgaagcggcagagtt

SEQ ID NO: 71662 - DNA, 15 bp, Artificial Sequence
  dgRNA
  Atf7ip2
gtccactgtggtatc

SEQ ID NO: 71663 - DNA, 15 bp, Artificial Sequence
  dgRNA
  Atf7ip2
ggccaatcgccatcc

SEQ ID NO: 71664 - DNA, 15 bp, Artificial Sequence
  dgRNA
  Atf7ip2
ccgaattgtcacagt

SEQ ID NO: 71665 - DNA, 15 bp, Artificial Sequence
  dgRNA
  Trim42
acgccagctcagagg

SEQ ID NO: 71666 - DNA, 15 bp, Artificial Sequence
  dgRNA
  Trim42
gaccaccacctgtga

SEQ ID NO: 71667 - DNA, 15 bp, Artificial Sequence
  dgRNA
  Trim42
gaaggcctcataaac

SEQ ID NO: 71668 - DNA, 15 bp, Artificial Sequence
  dgRNA
  Trim42
gctgggatacatact

SEQ ID NO: 71669 - DNA, 15 bp, Artificial Sequence
  dgRNA
  Bbs10
acctagcggttgcag

SEQ ID NO: 71670 - DNA, 15 bp, Artificial Sequence
  dgRNA
  Bbs10
gcggttgcagtggcc

SEQ ID NO: 71671 - DNA, 15 bp, Artificial Sequence
  dgRNA
  Bbs10
cggttgcagtggcca

SEQ ID NO: 71672 - DNA, 15 bp, Artificial Sequence
  dgRNA
  Bbs10
gccagggaggcccgc

SEQ ID NO: 71673 - DNA, 15 bp, Artificial Sequence
  dgRNA
  Ankmy1
tctgagacaggcccg

SEQ ID NO: 71674 - DNA, 15 bp, Artificial Sequence
  dgRNA
  Ankmy1
attgcagatttgtcc

SEQ ID NO: 71675 - DNA, 15 bp, Artificial Sequence
  dgRNA
  Ankmy1
agatttgtccagggg

SEQ ID NO: 71676 - DNA, 15 bp, Artificial Sequence
  dgRNA
  Ankmy1
gatttgtccaggggc

SEQ ID NO: 71677 - DNA, 15 bp, Artificial Sequence
  dgRNA
  Olfr975
aaagttcagctaagt

SEQ ID NO: 71678 - DNA, 15 bp, Artificial Sequence
  dgRNA
  Olfr975
atcgtctcatcttct

SEQ ID NO: 71679 - DNA, 15 bp, Artificial Sequence
  dgRNA
  Olfr975
ctttgcagaaccctc

SEQ ID NO: 71680 - DNA, 15 bp, Artificial Sequence
  dgRNA
  Olfr975
tagaagatgagacga

SEQ ID NO: 71681 - DNA, 15 bp, Artificial Sequence
  dgRNA
  Nptxr
cgtggcgcacgcagt

SEQ ID NO: 71682 - DNA, 15 bp, Artificial Sequence
  dgRNA
  Nptxr
gtggcgcacgcagtc

SEQ ID NO: 71683 - DNA, 15 bp, Artificial Sequence
  dgRNA
  Nptxr
acgcagtcgggctcc

SEQ ID NO: 71684 - DNA, 15 bp, Artificial Sequence
  dgRNA
  Nptxr
gtcgggctcccggca

SEQ ID NO: 71685 - DNA, 15 bp, Artificial Sequence
  dgRNA
  Phox2a
aagggactctcggat

SEQ ID NO: 71686 - DNA, 15 bp, Artificial Sequence
  dgRNA
  Phox2a
agggactctcggatt

SEQ ID NO: 71687 - DNA, 15 bp, Artificial Sequence
  dgRNA
  Phox2a
gggactctcggattg

SEQ ID NO: 71688 - DNA, 15 bp, Artificial Sequence
  dgRNA
  Phox2a
gctccgcctgcacct

SEQ ID NO: 71689 - DNA, 15 bp, Artificial Sequence
  dgRNA
  Nid1
ggggaacctcggtgt

SEQ ID NO: 71690 - DNA, 15 bp, Artificial Sequence
  dgRNA
  Nid1
agagggccgacaccg

SEQ ID NO: 71691 - DNA, 15 bp, Artificial Sequence
  dgRNA
  Gtf2a1
acccggccacccagc

SEQ ID NO: 71692 - DNA, 15 bp, Artificial Sequence
  dgRNA
  Gtf2a1
ccggccacccagccg

SEQ ID NO: 71693 - DNA, 15 bp, Artificial Sequence
  dgRNA
  Gtf2a1
cacccagccggggcg

SEQ ID NO: 71694 - DNA, 15 bp, Artificial Sequence
  dgRNA
  Gtf2a1
acccagccggggcgg

SEQ ID NO: 71695 - DNA, 15 bp, Artificial Sequence
  dgRNA
  Cyp2c68
acccacatgtcttac

SEQ ID NO: 71696 - DNA, 15 bp, Artificial Sequence
  dgRNA
  Cyp2c68
gaaacaaagtccaat

SEQ ID NO: 71697 - DNA, 15 bp, Artificial Sequence
  dgRNA
  Cyp2c68
gcactacaaagtgtc

SEQ ID NO: 71698 - DNA, 15 bp, Artificial Sequence
  dgRNA
  Cyp2c68
taactctcttccaat

SEQ ID NO: 71699 - DNA, 15 bp, Artificial Sequence
  dgRNA
  Olfr1193
tgttatattacctaa

SEQ ID NO: 71700 - DNA, 15 bp, Artificial Sequence
  dgRNA
  Myh7
agtactgtttggaca

SEQ ID NO: 71701 - DNA, 15 bp, Artificial Sequence
  dgRNA
  Myh7
tggtcgtcattgttg

SEQ ID NO: 71702 - DNA, 15 bp, Artificial Sequence
  dgRNA
  Calcr
gggtccggaggagca

SEQ ID NO: 71703 - DNA, 15 bp, Artificial Sequence
  dgRNA
  Calcr
cggaggagcacggag

SEQ ID NO: 71704 - DNA, 15 bp, Artificial Sequence
  dgRNA
  Calcr
tagcccctccctccg

SEQ ID NO: 71705 - DNA, 15 bp, Artificial Sequence
  dgRNA
  Calcr
ccctccgagggctga

SEQ ID NO: 71706 - DNA, 15 bp, Artificial Sequence
  dgRNA
  Atp6v0b
aaactgggagtccgg

SEQ ID NO: 71707 - DNA, 15 bp, Artificial Sequence
  dgRNA
  Atp6v0b
aactgggagtccggt

SEQ ID NO: 71708 - DNA, 15 bp, Artificial Sequence
  dgRNA
  Atp6v0b
gtccggtgggaagtt

SEQ ID NO: 71709 - DNA, 15 bp, Artificial Sequence
  dgRNA
  Atp6v0b
gggaaccagcagcgc

SEQ ID NO: 71710 - DNA, 15 bp, Artificial Sequence
  dgRNA
  Gse1
gggttgtgaccgcgc

SEQ ID NO: 71711 - DNA, 15 bp, Artificial Sequence
  dgRNA
  Gse1
ggttgtgaccgcgct

SEQ ID NO: 71712 - DNA, 15 bp, Artificial Sequence
  dgRNA
  Gse1
ccgcgctgggtgctc

SEQ ID NO: 71713 - DNA, 15 bp, Artificial Sequence
  dgRNA
  Gse1
cgcgctgggtgctcc

SEQ ID NO: 71714 - DNA, 15 bp, Artificial Sequence
  dgRNA
  Pigp
gagcctcacgaaggc

SEQ ID NO: 71715 - DNA, 15 bp, Artificial Sequence
  dgRNA
  Pigp
cacgaaggctgggac

SEQ ID NO: 71716 - DNA, 15 bp, Artificial Sequence
  dgRNA
  Pigp
acgaaggctgggaca

SEQ ID NO: 71717 - DNA, 15 bp, Artificial Sequence
  dgRNA
  Pigp
gggcccatcatgaga

SEQ ID NO: 71718 - DNA, 15 bp, Artificial Sequence
  dgRNA
  Cox15
tccctcgctcgcctt

SEQ ID NO: 71719 - DNA, 15 bp, Artificial Sequence
  dgRNA
  Cox15
cggccgcgcgagcga

SEQ ID NO: 71720 - DNA, 15 bp, Artificial Sequence
  dgRNA
  Cox15
ccgcgcgagcgacgg

SEQ ID NO: 71721 - DNA, 15 bp, Artificial Sequence
  dgRNA
  Cox15
cgcgagcgacggagg

SEQ ID NO: 71722 - DNA, 15 bp, Artificial Sequence
  dgRNA
  Npnt
cctcgctctacctgc

SEQ ID NO: 71723 - DNA, 15 bp, Artificial Sequence
  dgRNA
  Npnt
ggctgccgacttcga

SEQ ID NO: 71724 - DNA, 15 bp, Artificial Sequence
  dgRNA
  Npnt
gctgccgacttcgac

SEQ ID NO: 71725 - DNA, 15 bp, Artificial Sequence
  dgRNA
  Npnt
gccgacttcgacggg

SEQ ID NO: 71726 - DNA, 15 bp, Artificial Sequence
  dgRNA
  Zfp428
catccactatttata

SEQ ID NO: 71727 - DNA, 15 bp, Artificial Sequence
  dgRNA
  Zfp428
gggggcctaaatact

SEQ ID NO: 71728 - DNA, 15 bp, Artificial Sequence
  dgRNA
  Zfp428
gatgccttggaatga

SEQ ID NO: 71729 - DNA, 15 bp, Artificial Sequence
  dgRNA
  Zfp428
aaatagtggatgcct

SEQ ID NO: 71730 - DNA, 15 bp, Artificial Sequence
  dgRNA
  Olfr819
gttagcatagagata

SEQ ID NO: 71731 - DNA, 15 bp, Artificial Sequence
  dgRNA
  Olfr819
ttagcatagagatat

SEQ ID NO: 71732 - DNA, 15 bp, Artificial Sequence
  dgRNA
  Olfr819
tagcatagagatatg

SEQ ID NO: 71733 - DNA, 15 bp, Artificial Sequence
  dgRNA
  Cenpk
ctgtaatttataagg

SEQ ID NO: 71734 - DNA, 15 bp, Artificial Sequence
  dgRNA
  Cenpk
gcgagaaattcacga

SEQ ID NO: 71735 - DNA, 15 bp, Artificial Sequence
  dgRNA
  Cenpk
cgagaaattcacgaa

SEQ ID NO: 71736 - DNA, 15 bp, Artificial Sequence
  dgRNA
  Cenpk
ttttcgggaaaaaac

SEQ ID NO: 71737 - DNA, 15 bp, Artificial Sequence
  dgRNA
  2210010C04Rik
ggcacccatggccat

SEQ ID NO: 71738 - DNA, 15 bp, Artificial Sequence
  dgRNA
  2210010C04Rik
acaaactcacctggt

SEQ ID NO: 71739 - DNA, 15 bp, Artificial Sequence
  dgRNA
  2210010C04Rik
aacaaactcacctgg

SEQ ID NO: 71740 - DNA, 15 bp, Artificial Sequence
  dgRNA
  2210010C04Rik
aaatctaaagggtgt

SEQ ID NO: 71741 - DNA, 15 bp, Artificial Sequence
  dgRNA
  Idua
tgcactatggcgact

SEQ ID NO: 71742 - DNA, 15 bp, Artificial Sequence
  dgRNA
  Idua
cctgaccttaaaagc

SEQ ID NO: 71743 - DNA, 15 bp, Artificial Sequence
  dgRNA
  Idua
gggtgtcacctccat

SEQ ID NO: 71744 - DNA, 15 bp, Artificial Sequence
  dgRNA
  Idua
gcagttgttgggcct

SEQ ID NO: 71745 - DNA, 15 bp, Artificial Sequence
  dgRNA
  Dopey2
ccaaccccgccacca

SEQ ID NO: 71746 - DNA, 15 bp, Artificial Sequence
  dgRNA
  Dopey2
agagtcccgcccacg

SEQ ID NO: 71747 - DNA, 15 bp, Artificial Sequence
  dgRNA
  Dopey2
cgcccacgaggagag

SEQ ID NO: 71748 - DNA, 15 bp, Artificial Sequence
  dgRNA
  Dopey2
gccgccataccgtta

SEQ ID NO: 71749 - DNA, 15 bp, Artificial Sequence
  dgRNA
  Sit1
tactccctgctcaag

SEQ ID NO: 71750 - DNA, 15 bp, Artificial Sequence
  dgRNA
  Sit1
caggtggcacgagac

SEQ ID NO: 71751 - DNA, 15 bp, Artificial Sequence
  dgRNA
  Sit1
gagtccccttgagca

SEQ ID NO: 71752 - DNA, 15 bp, Artificial Sequence
  dgRNA
  Evpl
gggcgccccgcccct

SEQ ID NO: 71753 - DNA, 15 bp, Artificial Sequence
  dgRNA
  Evpl
gctggctgcgcacgt

SEQ ID NO: 71754 - DNA, 15 bp, Artificial Sequence
  dgRNA
  Evpl
ctggctgcgcacgtc

SEQ ID NO: 71755 - DNA, 15 bp, Artificial Sequence
  dgRNA
  Evpl
tggctgcgcacgtcg

SEQ ID NO: 71756 - DNA, 15 bp, Artificial Sequence
  dgRNA
  Olfr153
gaccaatatctggga

SEQ ID NO: 71757 - DNA, 15 bp, Artificial Sequence
  dgRNA
  Mettl6
cggccgcagtccccc

SEQ ID NO: 71758 - DNA, 15 bp, Artificial Sequence
  dgRNA
  Mettl6
ggatccccgcgcaag

SEQ ID NO: 71759 - DNA, 15 bp, Artificial Sequence
  dgRNA
  Mettl6
gcgcaagcggcccgc

SEQ ID NO: 71760 - DNA, 15 bp, Artificial Sequence
  dgRNA
  Mettl6
gcaggaccgcgctcc

SEQ ID NO: 71761 - DNA, 15 bp, Artificial Sequence
  dgRNA
  Hsd11b1
gccaaatctcaccct

SEQ ID NO: 71762 - DNA, 15 bp, Artificial Sequence
  dgRNA
  Ormdl3
tcttcgactacaaga

SEQ ID NO: 71763 - DNA, 15 bp, Artificial Sequence
  dgRNA
  Ormdl3
cttcgactacaagat

SEQ ID NO: 71764 - DNA, 15 bp, Artificial Sequence
  dgRNA
  Ormdl3
ttgtgcaacacgtga

SEQ ID NO: 71765 - DNA, 15 bp, Artificial Sequence
  dgRNA
  Ormdl3
tgtgcaacacgtgaa

SEQ ID NO: 71766 - DNA, 15 bp, Artificial Sequence
  dgRNA
  S100pbp
atgacgcaccctctc

SEQ ID NO: 71767 - DNA, 15 bp, Artificial Sequence
  dgRNA
  S100pbp
tgacgcaccctctca

SEQ ID NO: 71768 - DNA, 15 bp, Artificial Sequence
  dgRNA
  S100pbp
ttggccccgctgcct

SEQ ID NO: 71769 - DNA, 15 bp, Artificial Sequence
  dgRNA
  S100pbp
ggccccgctgcctcg

SEQ ID NO: 71770 - DNA, 15 bp, Artificial Sequence
  dgRNA
  Rasl11a
ggtgctccagactgg

SEQ ID NO: 71771 - DNA, 15 bp, Artificial Sequence
  dgRNA
  Rasl11a
aggaacccgcgcagc

SEQ ID NO: 71772 - DNA, 15 bp, Artificial Sequence
  dgRNA
  Rasl11a
ggaacccgcgcagct

SEQ ID NO: 71773 - DNA, 15 bp, Artificial Sequence
  dgRNA
  Rasl11a
acccgcgcagctggg

SEQ ID NO: 71774 - DNA, 15 bp, Artificial Sequence
  dgRNA
  Chrm1
gcgtgggcatgttca

SEQ ID NO: 71775 - DNA, 15 bp, Artificial Sequence
  dgRNA
  Chrm1
cgtgggcatgttcat

SEQ ID NO: 71776 - DNA, 15 bp, Artificial Sequence
  dgRNA
  Chrm1
ggcatgtgaataatg

SEQ ID NO: 71777 - DNA, 15 bp, Artificial Sequence
  dgRNA
  Chrm1
tcggggcatgtgtgt

SEQ ID NO: 71778 - DNA, 15 bp, Artificial Sequence
  dgRNA
  Mri1
ggtgtctgtgagccg

SEQ ID NO: 71779 - DNA, 15 bp, Artificial Sequence
  dgRNA
  Mri1
ctgtgagccgtggat

SEQ ID NO: 71780 - DNA, 15 bp, Artificial Sequence
  dgRNA
  Mri1
tcatcgcttcagtaa

SEQ ID NO: 71781 - DNA, 15 bp, Artificial Sequence
  dgRNA
  Mri1
cgcttcagtaacgga

SEQ ID NO: 71782 - DNA, 15 bp, Artificial Sequence
  dgRNA
  Lims1
cgctccgccccgttc

SEQ ID NO: 71783 - DNA, 15 bp, Artificial Sequence
  dgRNA
  Lims1
gctccgccccgttcc

SEQ ID NO: 71784 - DNA, 15 bp, Artificial Sequence
  dgRNA
  Lims1
cgtcctacccacgcg

SEQ ID NO: 71785 - DNA, 15 bp, Artificial Sequence
  dgRNA
  Lims1
cgccccgccctagtc

SEQ ID NO: 71786 - DNA, 15 bp, Artificial Sequence
  dgRNA
  Tgm6
cgccgaacaccttct

SEQ ID NO: 71787 - DNA, 15 bp, Artificial Sequence
  dgRNA
  Tgm6
accaaagcaattact

SEQ ID NO: 71788 - DNA, 15 bp, Artificial Sequence
  dgRNA
  Tgm6
gccacgcctcttctc

SEQ ID NO: 71789 - DNA, 15 bp, Artificial Sequence
  dgRNA
  Tgm6
ccgacttcactgcct

SEQ ID NO: 71790 - DNA, 15 bp, Artificial Sequence
  dgRNA
  2310033P09Rik
cacacgagagttatc

SEQ ID NO: 71791 - DNA, 15 bp, Artificial Sequence
  dgRNA
  2310033P09Rik
acgagagttatcagg

SEQ ID NO: 71792 - DNA, 15 bp, Artificial Sequence
  dgRNA
  2310033P09Rik
cgagagttatcaggt

SEQ ID NO: 71793 - DNA, 15 bp, Artificial Sequence
  dgRNA
  2310033P09Rik
acagccgcctttttg

SEQ ID NO: 71794 - DNA, 15 bp, Artificial Sequence
  dgRNA
  Synpr
gggagtgcacaacgg

SEQ ID NO: 71795 - DNA, 15 bp, Artificial Sequence
  dgRNA
  Olfr871
cacatgtctcctaaa

SEQ ID NO: 71796 - DNA, 15 bp, Artificial Sequence
  dgRNA
  Hk1
cctgctgtaccaccg

SEQ ID NO: 71797 - DNA, 15 bp, Artificial Sequence
  dgRNA
  Hk1
taagcaggtttgagg

SEQ ID NO: 71798 - DNA, 15 bp, Artificial Sequence
  dgRNA
  Hk1
agtccctaggtatct

SEQ ID NO: 71799 - DNA, 15 bp, Artificial Sequence
  dgRNA
  Hk1
atcatctatcccaaa

SEQ ID NO: 71800 - DNA, 15 bp, Artificial Sequence
  dgRNA
  Cpxcr1
ttaatgcacatctag

SEQ ID NO: 71801 - DNA, 15 bp, Artificial Sequence
  dgRNA
  Cpxcr1
ttgtgatgcatacaa

SEQ ID NO: 71802 - DNA, 15 bp, Artificial Sequence
  dgRNA
  Camsap1
gacacggactgggct

SEQ ID NO: 71803 - DNA, 15 bp, Artificial Sequence
  dgRNA
  Camsap1
actgggctaggttag

SEQ ID NO: 71804 - DNA, 15 bp, Artificial Sequence
  dgRNA
  Camsap1
tgggctaggttagag

SEQ ID NO: 71805 - DNA, 15 bp, Artificial Sequence
  dgRNA
  Camsap1
gcgtgcctactctgc

SEQ ID NO: 71806 - DNA, 15 bp, Artificial Sequence
  dgRNA
  Prkg1
gaaaccaggctcttt

SEQ ID NO: 71807 - DNA, 15 bp, Artificial Sequence
  dgRNA
  Prkg1
accaggctctttcgg

SEQ ID NO: 71808 - DNA, 15 bp, Artificial Sequence
  dgRNA
  Prkg1
ccaggctctttcggt

SEQ ID NO: 71809 - DNA, 15 bp, Artificial Sequence
  dgRNA
  Prkg1
caggctctttcggtg

SEQ ID NO: 71810 - DNA, 15 bp, Artificial Sequence
  dgRNA
  Tdrd9
aacacgtgcctgtcc

SEQ ID NO: 71811 - DNA, 15 bp, Artificial Sequence
  dgRNA
  Tdrd9
cgcgcatgctccaga

SEQ ID NO: 71812 - DNA, 15 bp, Artificial Sequence
  dgRNA
  Tdrd9
gctccagaaggcacg

SEQ ID NO: 71813 - DNA, 15 bp, Artificial Sequence
  dgRNA
  Tdrd9
cgtgcatgcagggcc

SEQ ID NO: 71814 - DNA, 15 bp, Artificial Sequence
  dgRNA
  4931414P19Rik
gtgggcgcatcggcc

SEQ ID NO: 71815 - DNA, 15 bp, Artificial Sequence
  dgRNA
  4931414P19Rik
cgcatcggccaggtc

SEQ ID NO: 71816 - DNA, 15 bp, Artificial Sequence
  dgRNA
  4931414P19Rik
gcatcggccaggtcc

SEQ ID NO: 71817 - DNA, 15 bp, Artificial Sequence
  dgRNA
  4931414P19Rik
aggtccgggagctcg

SEQ ID NO: 71818 - DNA, 15 bp, Artificial Sequence
  dgRNA
  Cilp
tctcatgctcagatc

SEQ ID NO: 71819 - DNA, 15 bp, Artificial Sequence
  dgRNA
  Cilp
gctatataagacggc

SEQ ID NO: 71820 - DNA, 15 bp, Artificial Sequence
  dgRNA
  Cilp
acatcaagatcctta

SEQ ID NO: 71821 - DNA, 15 bp, Artificial Sequence
  dgRNA
  Cilp
atatagcacagctgg

SEQ ID NO: 71822 - DNA, 15 bp, Artificial Sequence
  dgRNA
  Enpp5
gctggcgggagccaa

SEQ ID NO: 71823 - DNA, 15 bp, Artificial Sequence
  dgRNA
  mt-Nd6
ggcagactcctagaa

SEQ ID NO: 71824 - DNA, 15 bp, Artificial Sequence
  dgRNA
  mt-Nd6
gatgaaatgttggat

SEQ ID NO: 71825 - DNA, 15 bp, Artificial Sequence
  dgRNA
  mt-Nd6
cgtatgtttgtcatt

SEQ ID NO: 71826 - DNA, 15 bp, Artificial Sequence
  dgRNA
  mt-Nd6
agtccaaatcattac

SEQ ID NO: 71827 - DNA, 15 bp, Artificial Sequence
  dgRNA
  Guf1
cgtttgcttcgcgtc

SEQ ID NO: 71828 - DNA, 15 bp, Artificial Sequence
  dgRNA
  Guf1
gcttcgcgtcaggcc

SEQ ID NO: 71829 - DNA, 15 bp, Artificial Sequence
  dgRNA
  Guf1
cttcgcgtcaggcct

SEQ ID NO: 71830 - DNA, 15 bp, Artificial Sequence
  dgRNA
  Guf1
ctgacaccgagaccc

SEQ ID NO: 71831 - DNA, 15 bp, Artificial Sequence
  dgRNA
  Hgfac
ggttgtgttgggccg

SEQ ID NO: 71832 - DNA, 15 bp, Artificial Sequence
  dgRNA
  Hgfac
gtggaggagcctaac

SEQ ID NO: 71833 - DNA, 15 bp, Artificial Sequence
  dgRNA
  Hgfac
gctacaactgctcct

SEQ ID NO: 71834 - DNA, 15 bp, Artificial Sequence
  dgRNA
  Ano9
tggcgggacactgga

SEQ ID NO: 71835 - DNA, 15 bp, Artificial Sequence
  dgRNA
  Ano9
ggcgggacactggaa

SEQ ID NO: 71836 - DNA, 15 bp, Artificial Sequence
  dgRNA
  Ano9
tggcgggcttgctgc

SEQ ID NO: 71837 - DNA, 15 bp, Artificial Sequence
  dgRNA
  Ano9
cggggcaaatccaca

SEQ ID NO: 71838 - DNA, 15 bp, Artificial Sequence
  dgRNA
  Palb2
agagcggctagcgcg

SEQ ID NO: 71839 - DNA, 15 bp, Artificial Sequence
  dgRNA
  Palb2
gcgcgctagccgctc

SEQ ID NO: 71840 - DNA, 15 bp, Artificial Sequence
  dgRNA
  Ubr5
cacgccgccccgccc

SEQ ID NO: 71841 - DNA, 15 bp, Artificial Sequence
  dgRNA
  Ubr5
ccgccccggggggcc

SEQ ID NO: 71842 - DNA, 15 bp, Artificial Sequence
  dgRNA
  Ubr5
gcccagcgcgccaat

SEQ ID NO: 71843 - DNA, 15 bp, Artificial Sequence
  dgRNA
  Ubr5
cccgacaacgttaag

SEQ ID NO: 71844 - DNA, 15 bp, Artificial Sequence
  dgRNA
  Spaca5
atctacagttcatac

SEQ ID NO: 71845 - DNA, 15 bp, Artificial Sequence
  dgRNA
  Cd22
ccacaccatatctgc

SEQ ID NO: 71846 - DNA, 15 bp, Artificial Sequence
  dgRNA
  Cd22
gctggtctctcgcag

SEQ ID NO: 71847 - DNA, 15 bp, Artificial Sequence
  dgRNA
  Cd22
gtcacgtgttggctt

SEQ ID NO: 71848 - DNA, 15 bp, Artificial Sequence
  dgRNA
  Cd22
agtcacgtgttggct

SEQ ID NO: 71849 - DNA, 15 bp, Artificial Sequence
  dgRNA
  Mphosph8
cctcgcagtctcccc

SEQ ID NO: 71850 - DNA, 15 bp, Artificial Sequence
  dgRNA
  Mphosph8
ctcgcagtctcccca

SEQ ID NO: 71851 - DNA, 15 bp, Artificial Sequence
  dgRNA
  Mphosph8
tcgcagtctccccag

SEQ ID NO: 71852 - DNA, 15 bp, Artificial Sequence
  dgRNA
  Mphosph8
tcccgtgaactcccc

SEQ ID NO: 71853 - DNA, 15 bp, Artificial Sequence
  dgRNA
  Mto1
cgctgaaagtacctg

SEQ ID NO: 71854 - DNA, 15 bp, Artificial Sequence
  dgRNA
  Mto1
ctgaaagtacctgcg

SEQ ID NO: 71855 - DNA, 15 bp, Artificial Sequence
  dgRNA
  Mto1
tgaaagtacctgcgg

SEQ ID NO: 71856 - DNA, 15 bp, Artificial Sequence
  dgRNA
  Mto1
gaaagtacctgcggg

SEQ ID NO: 71857 - DNA, 15 bp, Artificial Sequence
  dgRNA
  Hpd
ctggcccgtggactg

SEQ ID NO: 71858 - DNA, 15 bp, Artificial Sequence
  dgRNA
  Hpd
cccgtggactgaggc

SEQ ID NO: 71859 - DNA, 15 bp, Artificial Sequence
  dgRNA
  Hpd
gggtcactctccctc

SEQ ID NO: 71860 - DNA, 15 bp, Artificial Sequence
  dgRNA
  Hpd
gcctaggattgccca

SEQ ID NO: 71861 - DNA, 15 bp, Artificial Sequence
  dgRNA
  Rgs1
ggccatacacatctc

SEQ ID NO: 71862 - DNA, 15 bp, Artificial Sequence
  dgRNA
  Rgs1
tttgattaggaaggc

SEQ ID NO: 71863 - DNA, 15 bp, Artificial Sequence
  dgRNA
  Rgs1
gtcatttgattagga

SEQ ID NO: 71864 - DNA, 15 bp, Artificial Sequence
  dgRNA
  Rgs1
gcaggtcatttgatt

SEQ ID NO: 71865 - DNA, 15 bp, Artificial Sequence
  dgRNA
  Psma6
tcatcagctctcaac

SEQ ID NO: 71866 - DNA, 15 bp, Artificial Sequence
  dgRNA
  Psma6
catcagctctcaacc

SEQ ID NO: 71867 - DNA, 15 bp, Artificial Sequence
  dgRNA
  Psma6
cgggcagaccattat

SEQ ID NO: 71868 - DNA, 15 bp, Artificial Sequence
  dgRNA
  Psma6
gggcagaccattatt

SEQ ID NO: 71869 - DNA, 15 bp, Artificial Sequence
  dgRNA
  4930480E11Rik
ctcctaatcttctgg

SEQ ID NO: 71870 - DNA, 15 bp, Artificial Sequence
  dgRNA
  4930480E11Rik
gtgggtttaaaaggt

SEQ ID NO: 71871 - DNA, 15 bp, Artificial Sequence
  dgRNA
  4930480E11Rik
tatcatatacaagtg

SEQ ID NO: 71872 - DNA, 15 bp, Artificial Sequence
  dgRNA
  4930480E11Rik
tcctaacatgaggta

SEQ ID NO: 71873 - DNA, 15 bp, Artificial Sequence
  dgRNA
  1110004F10Rik
accatacccatccac

SEQ ID NO: 71874 - DNA, 15 bp, Artificial Sequence
  dgRNA
  1110004F10Rik
aaagcgtagcctccg

SEQ ID NO: 71875 - DNA, 15 bp, Artificial Sequence
  dgRNA
  1110004F10Rik
aagcgtagcctccga

SEQ ID NO: 71876 - DNA, 15 bp, Artificial Sequence
  dgRNA
  1110004F10Rik
gcgagatgcttcgct

SEQ ID NO: 71877 - DNA, 15 bp, Artificial Sequence
  dgRNA
  Lrrc8e
atgcttaggggttga

SEQ ID NO: 71878 - DNA, 15 bp, Artificial Sequence
  dgRNA
  Lrrc8e
cgctgacacctgtcc

SEQ ID NO: 71879 - DNA, 15 bp, Artificial Sequence
  dgRNA
  Lrrc8e
ttgttagcgatcgcg

SEQ ID NO: 71880 - DNA, 15 bp, Artificial Sequence
  dgRNA
  Lrrc8e
agcgatcgcgtggcg

SEQ ID NO: 71881 - DNA, 15 bp, Artificial Sequence
  dgRNA
  Olfr435
gcatccaattttcag

SEQ ID NO: 71882 - DNA, 15 bp, Artificial Sequence
  dgRNA
  Zfp808
taaaaaacccgatct

SEQ ID NO: 71883 - DNA, 15 bp, Artificial Sequence
  dgRNA
  Zfp808
cgccaacagaaggac

SEQ ID NO: 71884 - DNA, 15 bp, Artificial Sequence
  dgRNA
  Zfp808
cgcctgtccttctgt

SEQ ID NO: 71885 - DNA, 15 bp, Artificial Sequence
  dgRNA
  Krtap21-1
agggtataaaagtcc

SEQ ID NO: 71886 - DNA, 15 bp, Artificial Sequence
  dgRNA
  Krtap21-1
ctctaggaactttaa

SEQ ID NO: 71887 - DNA, 15 bp, Artificial Sequence
  dgRNA
  Krtap21-1
acttactactactct

SEQ ID NO: 71888 - DNA, 15 bp, Artificial Sequence
  dgRNA
  Krtap21-1
gctcatacctcacat

SEQ ID NO: 71889 - DNA, 15 bp, Artificial Sequence
  dgRNA
  Obox7
cattgggatacacaa

SEQ ID NO: 71890 - DNA, 15 bp, Artificial Sequence
  dgRNA
  Sesn1
ggctacgagtccccg

SEQ ID NO: 71891 - DNA, 15 bp, Artificial Sequence
  dgRNA
  Sesn1
gctacgagtccccgc

SEQ ID NO: 71892 - DNA, 15 bp, Artificial Sequence
  dgRNA
  Sesn1
cgagtccccgcgggc

SEQ ID NO: 71893 - DNA, 15 bp, Artificial Sequence
  dgRNA
  Sesn1
cccgcgggccggcat

SEQ ID NO: 71894 - DNA, 15 bp, Artificial Sequence
  dgRNA
  Rps20
tctgtcctccgagtc

SEQ ID NO: 71895 - DNA, 15 bp, Artificial Sequence
  dgRNA
  Rps20
cctccgagtcaggac

SEQ ID NO: 71896 - DNA, 15 bp, Artificial Sequence
  dgRNA
  Rps20
ctccgagtcaggaca

SEQ ID NO: 71897 - DNA, 15 bp, Artificial Sequence
  dgRNA
  Rps20
agggactccgccgag

SEQ ID NO: 71898 - DNA, 15 bp, Artificial Sequence
  dgRNA
  Nxf1
cactaaactacccga

SEQ ID NO: 71899 - DNA, 15 bp, Artificial Sequence
  dgRNA
  Nxf1
ctacccgaaggactt

SEQ ID NO: 71900 - DNA, 15 bp, Artificial Sequence
  dgRNA
  Nxf1
tgtgtacttaacccc

SEQ ID NO: 71901 - DNA, 15 bp, Artificial Sequence
  dgRNA
  Nxf1
ttccctcaatgcagg

SEQ ID NO: 71902 - DNA, 15 bp, Artificial Sequence
  dgRNA
  Maff
ccggaggggcctccg

SEQ ID NO: 71903 - DNA, 15 bp, Artificial Sequence
  dgRNA
  Maff
cggaggggcctccga

SEQ ID NO: 71904 - DNA, 15 bp, Artificial Sequence
  dgRNA
  Maff
tccgaggggctggct

SEQ ID NO: 71905 - DNA, 15 bp, Artificial Sequence
  dgRNA
  Maff
tgggaggcggtgcgc

SEQ ID NO: 71906 - DNA, 15 bp, Artificial Sequence
  dgRNA
  Bdnf
ttcctcgtctgcggg

SEQ ID NO: 71907 - DNA, 15 bp, Artificial Sequence
  dgRNA
  Bdnf
acccttcctcgtctg

SEQ ID NO: 71908 - DNA, 15 bp, Artificial Sequence
  dgRNA
  Cbfa2t3
ggcccctcggccacc

SEQ ID NO: 71909 - DNA, 15 bp, Artificial Sequence
  dgRNA
  Cbfa2t3
gcccctcggccaccc

SEQ ID NO: 71910 - DNA, 15 bp, Artificial Sequence
  dgRNA
  Cbfa2t3
aggcgggagccgctc

SEQ ID NO: 71911 - DNA, 15 bp, Artificial Sequence
  dgRNA
  Cbfa2t3
ggcgggagccgctct

SEQ ID NO: 71912 - DNA, 15 bp, Artificial Sequence
  dgRNA
  Zeb2
ttaactttcgcccct

SEQ ID NO: 71913 - DNA, 15 bp, Artificial Sequence
  dgRNA
  Zeb2
cgcccagtactctgc

SEQ ID NO: 71914 - DNA, 15 bp, Artificial Sequence
  dgRNA
  Zeb2
ggataatgatgccaa

SEQ ID NO: 71915 - DNA, 15 bp, Artificial Sequence
  dgRNA
  Zeb2
aggcttgcttgacgg

SEQ ID NO: 71916 - DNA, 15 bp, Artificial Sequence
  dgRNA
  Slc1a6
ctcggaggcgcggct

SEQ ID NO: 71917 - DNA, 15 bp, Artificial Sequence
  dgRNA
  Slc1a6
agggggacatccccg

SEQ ID NO: 71918 - DNA, 15 bp, Artificial Sequence
  dgRNA
  Slc1a6
gggggacatccccga

SEQ ID NO: 71919 - DNA, 15 bp, Artificial Sequence
  dgRNA
  Slc1a6
ggggacatccccgag

SEQ ID NO: 71920 - DNA, 15 bp, Artificial Sequence
  dgRNA
  Neil1
acccagtaccttgga

SEQ ID NO: 71921 - DNA, 15 bp, Artificial Sequence
  dgRNA
  Neil1
cccagtaccttggat

SEQ ID NO: 71922 - DNA, 15 bp, Artificial Sequence
  dgRNA
  Neil1
agtaccttggatggg

SEQ ID NO: 71923 - DNA, 15 bp, Artificial Sequence
  dgRNA
  Neil1
tcctctgtacaaact

SEQ ID NO: 71924 - DNA, 15 bp, Artificial Sequence
  dgRNA
  Rit1
ttcgtatgtgaccag

SEQ ID NO: 71925 - DNA, 15 bp, Artificial Sequence
  dgRNA
  Rit1
tcgtatgtgaccaga

SEQ ID NO: 71926 - DNA, 15 bp, Artificial Sequence
  dgRNA
  Rit1
tagcgagttagagtt

SEQ ID NO: 71927 - DNA, 15 bp, Artificial Sequence
  dgRNA
  Rit1
agttagagttaggcg

SEQ ID NO: 71928 - DNA, 15 bp, Artificial Sequence
  dgRNA
  Ppp4r4
ccgcttcactctcat

SEQ ID NO: 71929 - DNA, 15 bp, Artificial Sequence
  dgRNA
  Ppp4r4
ggccgcctggggacg

SEQ ID NO: 71930 - DNA, 15 bp, Artificial Sequence
  dgRNA
  Ppp4r4
tgcgcacgcgccgag

SEQ ID NO: 71931 - DNA, 15 bp, Artificial Sequence
  dgRNA
  Ppp4r4
gcacgcgccgagggg

SEQ ID NO: 71932 - DNA, 15 bp, Artificial Sequence
  dgRNA
  Slc25a51
acttcagcttaagtc

SEQ ID NO: 71933 - DNA, 15 bp, Artificial Sequence
  dgRNA
  Slc25a51
cttcagcttaagtca

SEQ ID NO: 71934 - DNA, 15 bp, Artificial Sequence
  dgRNA
  Slc25a51
ttaagtcaggggggc

SEQ ID NO: 71935 - DNA, 15 bp, Artificial Sequence
  dgRNA
  Slc25a51
taagtcaggggggcg

SEQ ID NO: 71936 - DNA, 15 bp, Artificial Sequence
  dgRNA
  Epb41l4b
ccgggagcgggcgct

SEQ ID NO: 71937 - DNA, 15 bp, Artificial Sequence
  dgRNA
  Epb41l4b
ggagcgggcgctcgg

SEQ ID NO: 71938 - DNA, 15 bp, Artificial Sequence
  dgRNA
  Epb41l4b
gagcgggcgctcggc

SEQ ID NO: 71939 - DNA, 15 bp, Artificial Sequence
  dgRNA
  Epb41l4b
agcgggcgctcggcg

SEQ ID NO: 71940 - DNA, 15 bp, Artificial Sequence
  dgRNA
  Clmp
ccccctcgatcaccc

SEQ ID NO: 71941 - DNA, 15 bp, Artificial Sequence
  dgRNA
  Clmp
cccctcgatcacccc

SEQ ID NO: 71942 - DNA, 15 bp, Artificial Sequence
  dgRNA
  Clmp
gatcaccccgggccg

SEQ ID NO: 71943 - DNA, 15 bp, Artificial Sequence
  dgRNA
  Clmp
cgcggccctccctcc

SEQ ID NO: 71944 - DNA, 15 bp, Artificial Sequence
  dgRNA
  Rap1gap2
cccgctgctgcgcgg

SEQ ID NO: 71945 - DNA, 15 bp, Artificial Sequence
  dgRNA
  Rap1gap2
ccgctgctgcgcggt

SEQ ID NO: 71946 - DNA, 15 bp, Artificial Sequence
  dgRNA
  Rap1gap2
cgcggtgggcgccgc

SEQ ID NO: 71947 - DNA, 15 bp, Artificial Sequence
  dgRNA
  Rap1gap2
gcggtgggcgccgct

SEQ ID NO: 71948 - DNA, 15 bp, Artificial Sequence
  dgRNA
  Ube2m
gagcggaagcggcgc

SEQ ID NO: 71949 - DNA, 15 bp, Artificial Sequence
  dgRNA
  Ube2m
cggaagcggcgcagg

SEQ ID NO: 71950 - DNA, 15 bp, Artificial Sequence
  dgRNA
  Ube2m
aagcggcgcaggcgg

SEQ ID NO: 71951 - DNA, 15 bp, Artificial Sequence
  dgRNA
  Ube2m
gggtggccggggtcc

SEQ ID NO: 71952 - DNA, 15 bp, Artificial Sequence
  dgRNA
  Ppp2r3a
tcacagcggcggccg

SEQ ID NO: 71953 - DNA, 15 bp, Artificial Sequence
  dgRNA
  Ppp2r3a
ctcgcagtgcccctc

SEQ ID NO: 71954 - DNA, 15 bp, Artificial Sequence
  dgRNA
  Ppp2r3a
tcgcagtgcccctca

SEQ ID NO: 71955 - DNA, 15 bp, Artificial Sequence
  dgRNA
  Ppp2r3a
ctcagggcccccttt

SEQ ID NO: 71956 - DNA, 15 bp, Artificial Sequence
  dgRNA
  Cab39
aggaactagcaagta

SEQ ID NO: 71957 - DNA, 15 bp, Artificial Sequence
  dgRNA
  Cab39
ggaactagcaagtaa

SEQ ID NO: 71958 - DNA, 15 bp, Artificial Sequence
  dgRNA
  Cab39
acttgccggcgactc

SEQ ID NO: 71959 - DNA, 15 bp, Artificial Sequence
  dgRNA
  Cab39
cgtcccgagtccgcc

SEQ ID NO: 71960 - DNA, 15 bp, Artificial Sequence
  dgRNA
  Tcl1b5
cataacaggtagagc

SEQ ID NO: 71961 - DNA, 15 bp, Artificial Sequence
  dgRNA
  Pdik1l
atttgaagaactccg

SEQ ID NO: 71962 - DNA, 15 bp, Artificial Sequence
  dgRNA
  Pdik1l
tttgaagaactccgg

SEQ ID NO: 71963 - DNA, 15 bp, Artificial Sequence
  dgRNA
  Pdik1l
tacacccgcctaaaa

SEQ ID NO: 71964 - DNA, 15 bp, Artificial Sequence
  dgRNA
  Pdik1l
acacccgcctaaaat

SEQ ID NO: 71965 - DNA, 15 bp, Artificial Sequence
  dgRNA
  Hoxc8
cctgtcttcatgtcg

SEQ ID NO: 71966 - DNA, 15 bp, Artificial Sequence
  dgRNA
  Hoxc8
aagcgccgccaccgc

SEQ ID NO: 71967 - DNA, 15 bp, Artificial Sequence
  dgRNA
  Hoxc8
accgccgggagtctg

SEQ ID NO: 71968 - DNA, 15 bp, Artificial Sequence
  dgRNA
  Hoxc8
tctgaggaattcgcc

SEQ ID NO: 71969 - DNA, 15 bp, Artificial Sequence
  dgRNA
  Tdrd1
gggagtaaactgcgc

SEQ ID NO: 71970 - DNA, 15 bp, Artificial Sequence
  dgRNA
  Tdrd1
taaactgcgcaggcg

SEQ ID NO: 71971 - DNA, 15 bp, Artificial Sequence
  dgRNA
  Tdrd1
aaactgcgcaggcgc

SEQ ID NO: 71972 - DNA, 15 bp, Artificial Sequence
  dgRNA
  Tdrd1
gggccccgcaccacg

SEQ ID NO: 71973 - DNA, 15 bp, Artificial Sequence
  dgRNA
  Pwwp2a
tcagcccgcgacaga

SEQ ID NO: 71974 - DNA, 15 bp, Artificial Sequence
  dgRNA
  Pwwp2a
gacagaagtgcggaa

SEQ ID NO: 71975 - DNA, 15 bp, Artificial Sequence
  dgRNA
  Pwwp2a
acagaagtgcggaag

SEQ ID NO: 71976 - DNA, 15 bp, Artificial Sequence
  dgRNA
  Pwwp2a
cagaagtgcggaagg

SEQ ID NO: 71977 - DNA, 15 bp, Artificial Sequence
  dgRNA
  Pfkfb4
gggcgggaccatgag

SEQ ID NO: 71978 - DNA, 15 bp, Artificial Sequence
  dgRNA
  Pfkfb4
ggcgggaccatgagt

SEQ ID NO: 71979 - DNA, 15 bp, Artificial Sequence
  dgRNA
  Pfkfb4
gcgggaccatgagtg

SEQ ID NO: 71980 - DNA, 15 bp, Artificial Sequence
  dgRNA
  Pfkfb4
catataagaacaatc

SEQ ID NO: 71981 - DNA, 15 bp, Artificial Sequence
  dgRNA
  Tusc5
gagatatttccaagg

SEQ ID NO: 71982 - DNA, 15 bp, Artificial Sequence
  dgRNA
  Rubcn
ctgtcgttagttaca

SEQ ID NO: 71983 - DNA, 15 bp, Artificial Sequence
  dgRNA
  Rubcn
tggagcttttaatca

SEQ ID NO: 71984 - DNA, 15 bp, Artificial Sequence
  dgRNA
  Rubcn
acatcacgtgtaccc

SEQ ID NO: 71985 - DNA, 15 bp, Artificial Sequence
  dgRNA
  Rubcn
acgtgtacccaggtt

SEQ ID NO: 71986 - DNA, 15 bp, Artificial Sequence
  dgRNA
  Ttc8
cgagcgggaggcgtc

SEQ ID NO: 71987 - DNA, 15 bp, Artificial Sequence
  dgRNA
  Ttc8
tcgggagcagcgagc

SEQ ID NO: 71988 - DNA, 15 bp, Artificial Sequence
  dgRNA
  Ttc8
ttcgggagcagcgag

SEQ ID NO: 71989 - DNA, 15 bp, Artificial Sequence
  dgRNA
  Ntmt1
tgtgtttgggcgagc

SEQ ID NO: 71990 - DNA, 15 bp, Artificial Sequence
  dgRNA
  Ntmt1
gtgtttgggcgagct

SEQ ID NO: 71991 - DNA, 15 bp, Artificial Sequence
  dgRNA
  Ntmt1
gggcgagctgggcgt

SEQ ID NO: 71992 - DNA, 15 bp, Artificial Sequence
  dgRNA
  Ntmt1
ggcgagttagtcgcg

SEQ ID NO: 71993 - DNA, 15 bp, Artificial Sequence
  dgRNA
  Ptgfr
ttccgcgtccctttt

SEQ ID NO: 71994 - DNA, 15 bp, Artificial Sequence
  dgRNA
  Ptgfr
gcgtccctttttggt

SEQ ID NO: 71995 - DNA, 15 bp, Artificial Sequence
  dgRNA
  Ptgfr
ctttttggttggacc

SEQ ID NO: 71996 - DNA, 15 bp, Artificial Sequence
  dgRNA
  Ptgfr
ctttccgtagttgcc

SEQ ID NO: 71997 - DNA, 15 bp, Artificial Sequence
  dgRNA
  Nifk
ctcaattctagacac

SEQ ID NO: 71998 - DNA, 15 bp, Artificial Sequence
  dgRNA
  Nifk
caattctagacaccg

SEQ ID NO: 71999 - DNA, 15 bp, Artificial Sequence
  dgRNA
  Nifk
ggattaaggctccgt

SEQ ID NO: 72000 - DNA, 15 bp, Artificial Sequence
  dgRNA
  Nifk
tcgagcgccacctac

SEQ ID NO: 72001 - DNA, 15 bp, Artificial Sequence
  dgRNA
  Rpp21
taacaccagttattc

SEQ ID NO: 72002 - DNA, 15 bp, Artificial Sequence
  dgRNA
  Rpp21
ccaagcatctaccct

SEQ ID NO: 72003 - DNA, 15 bp, Artificial Sequence
  dgRNA
  Rpp21
ccaaccataaaagac

SEQ ID NO: 72004 - DNA, 15 bp, Artificial Sequence
  dgRNA
  Rpp21
actaccataaattac

SEQ ID NO: 72005 - DNA, 15 bp, Artificial Sequence
  dgRNA
  Raet1d
gcagaacttttcacg

SEQ ID NO: 72006 - DNA, 15 bp, Artificial Sequence
  dgRNA
  Raet1d
agcaccagcattcgc

SEQ ID NO: 72007 - DNA, 15 bp, Artificial Sequence
  dgRNA
  Raet1d
gcattcgctggcgcg

SEQ ID NO: 72008 - DNA, 15 bp, Artificial Sequence
  dgRNA
  Raet1d
cattcgctggcgcga

SEQ ID NO: 72009 - DNA, 15 bp, Artificial Sequence
  dgRNA
  Pnma5
caaccaaaggtcagc

SEQ ID NO: 72010 - DNA, 15 bp, Artificial Sequence
  dgRNA
  Pnma5
acaagactgaatgtc

SEQ ID NO: 72011 - DNA, 15 bp, Artificial Sequence
  dgRNA
  Pnma5
aaccctgctgacctt

SEQ ID NO: 72012 - DNA, 15 bp, Artificial Sequence
  dgRNA
  Pnma5
caatgccatatagaa

SEQ ID NO: 72013 - DNA, 15 bp, Artificial Sequence
  dgRNA
  Rfwd3
aggaggcgccttggc

SEQ ID NO: 72014 - DNA, 15 bp, Artificial Sequence
  dgRNA
  Rfwd3
aggcgccttggccgg

SEQ ID NO: 72015 - DNA, 15 bp, Artificial Sequence
  dgRNA
  Rfwd3
aaaggctgaccaatg

SEQ ID NO: 72016 - DNA, 15 bp, Artificial Sequence
  dgRNA
  Rfwd3
aaggctgaccaatga

SEQ ID NO: 72017 - DNA, 15 bp, Artificial Sequence
  dgRNA
  Katnbl1
ttgtcccttacccgc

SEQ ID NO: 72018 - DNA, 15 bp, Artificial Sequence
  dgRNA
  Katnbl1
cttgtggcaaagcgt

SEQ ID NO: 72019 - DNA, 15 bp, Artificial Sequence
  dgRNA
  Katnbl1
cgtcggacgcacctg

SEQ ID NO: 72020 - DNA, 15 bp, Artificial Sequence
  dgRNA
  Katnbl1
gcacctgtggacacg

SEQ ID NO: 72021 - DNA, 15 bp, Artificial Sequence
  dgRNA
  Me2
agaggaaccgagccg

SEQ ID NO: 72022 - DNA, 15 bp, Artificial Sequence
  dgRNA
  Me2
gaggaaccgagccga

SEQ ID NO: 72023 - DNA, 15 bp, Artificial Sequence
  dgRNA
  Me2
gaaccgagccgaggg

SEQ ID NO: 72024 - DNA, 15 bp, Artificial Sequence
  dgRNA
  Me2
gccgagggcggaacc

SEQ ID NO: 72025 - DNA, 15 bp, Artificial Sequence
  dgRNA
  Apaf1
ctgggcgcgagcccg

SEQ ID NO: 72026 - DNA, 15 bp, Artificial Sequence
  dgRNA
  Apaf1
cgagaacgctcaacc

SEQ ID NO: 72027 - DNA, 15 bp, Artificial Sequence
  dgRNA
  Apaf1
gagaacgctcaacca

SEQ ID NO: 72028 - DNA, 15 bp, Artificial Sequence
  dgRNA
  Apaf1
cttgcggtcacgcgc

SEQ ID NO: 72029 - DNA, 15 bp, Artificial Sequence
  dgRNA
  Mcoln1
gtcgccgagccagat

SEQ ID NO: 72030 - DNA, 15 bp, Artificial Sequence
  dgRNA
  Mcoln1
gttgctatcggcact

SEQ ID NO: 72031 - DNA, 15 bp, Artificial Sequence
  dgRNA
  Mcoln1
tttttagtccacaag

SEQ ID NO: 72032 - DNA, 15 bp, Artificial Sequence
  dgRNA
  Mcoln1
acaagcggccagcga

SEQ ID NO: 72033 - DNA, 15 bp, Artificial Sequence
  dgRNA
  Hax1
aaagaatctcctaga

SEQ ID NO: 72034 - DNA, 15 bp, Artificial Sequence
  dgRNA
  Hax1
gacgtgatcttgaac

SEQ ID NO: 72035 - DNA, 15 bp, Artificial Sequence
  dgRNA
  Hax1
acgtgatcttgaact

SEQ ID NO: 72036 - DNA, 15 bp, Artificial Sequence
  dgRNA
  Hax1
cgtgtctgaggagca

SEQ ID NO: 72037 - DNA, 15 bp, Artificial Sequence
  dgRNA
  Emg1
ctcgccttgcacacg

SEQ ID NO: 72038 - DNA, 15 bp, Artificial Sequence
  dgRNA
  Emg1
gcacacgaggatcgg

SEQ ID NO: 72039 - DNA, 15 bp, Artificial Sequence
  dgRNA
  Emg1
cggccttagagctcg

SEQ ID NO: 72040 - DNA, 15 bp, Artificial Sequence
  dgRNA
  Emg1
ggccttagagctcgc

SEQ ID NO: 72041 - DNA, 15 bp, Artificial Sequence
  dgRNA
  Rpl9
agtgtcaagggatcg

SEQ ID NO: 72042 - DNA, 15 bp, Artificial Sequence
  dgRNA
  Rpl9
gtgtcaagggatcga

SEQ ID NO: 72043 - DNA, 15 bp, Artificial Sequence
  dgRNA
  Rpl9
cagcacccccggcac

SEQ ID NO: 72044 - DNA, 15 bp, Artificial Sequence
  dgRNA
  Rpl9
tacgtcgtcgccgac

SEQ ID NO: 72045 - DNA, 15 bp, Artificial Sequence
  dgRNA
  Gip
tgattaggtgtataa

SEQ ID NO: 72046 - DNA, 15 bp, Artificial Sequence
  dgRNA
  Gip
gattaggtgtataat

SEQ ID NO: 72047 - DNA, 15 bp, Artificial Sequence
  dgRNA
  Gip
tataatgggcctcac

SEQ ID NO: 72048 - DNA, 15 bp, Artificial Sequence
  dgRNA
  Gip
ataatgggcctcact

SEQ ID NO: 72049 - DNA, 15 bp, Artificial Sequence
  dgRNA
  Timm44
tcccagaagaccaat

SEQ ID NO: 72050 - DNA, 15 bp, Artificial Sequence
  dgRNA
  Timm44
cccccgggttttccc

SEQ ID NO: 72051 - DNA, 15 bp, Artificial Sequence
  dgRNA
  Timm44
cgggttttcccaggc

SEQ ID NO: 72052 - DNA, 15 bp, Artificial Sequence
  dgRNA
  Timm44
gtaagcctcttgttg

SEQ ID NO: 72053 - DNA, 15 bp, Artificial Sequence
  dgRNA
  Ccdc32
gaatcaatccggtcc

SEQ ID NO: 72054 - DNA, 15 bp, Artificial Sequence
  dgRNA
  Ccdc32
taaggtactaaactc

SEQ ID NO: 72055 - DNA, 15 bp, Artificial Sequence
  dgRNA
  Ccdc32
tactaaactctggac

SEQ ID NO: 72056 - DNA, 15 bp, Artificial Sequence
  dgRNA
  Ccdc32
gattccatcgtttcc

SEQ ID NO: 72057 - DNA, 15 bp, Artificial Sequence
  dgRNA
  Ube2dnl2
tcaaacaagtacagt

SEQ ID NO: 72058 - DNA, 15 bp, Artificial Sequence
  dgRNA
  Dcaf6
cctctcctagggtga

SEQ ID NO: 72059 - DNA, 15 bp, Artificial Sequence
  dgRNA
  Dcaf6
aatcgtgacgcacag

SEQ ID NO: 72060 - DNA, 15 bp, Artificial Sequence
  dgRNA
  Dcaf6
catcctctcgcgaga

SEQ ID NO: 72061 - DNA, 15 bp, Artificial Sequence
  dgRNA
  Dcaf6
atcctctcgcgagaa

SEQ ID NO: 72062 - DNA, 15 bp, Artificial Sequence
  dgRNA
  Dynlt1a
cggggccctagagcg

SEQ ID NO: 72063 - DNA, 15 bp, Artificial Sequence
  dgRNA
  Dynlt1a
gccctagagcgtggg

SEQ ID NO: 72064 - DNA, 15 bp, Artificial Sequence
  dgRNA
  Dynlt1a
agcgtgggtggttat

SEQ ID NO: 72065 - DNA, 15 bp, Artificial Sequence
  dgRNA
  Dynlt1a
accacccacgctcta

SEQ ID NO: 72066 - DNA, 15 bp, Artificial Sequence
  dgRNA
  Gm17365
tactctaaaacagtc

SEQ ID NO: 72067 - DNA, 15 bp, Artificial Sequence
  dgRNA
  Gm17365
actctaaaacagtct

SEQ ID NO: 72068 - DNA, 15 bp, Artificial Sequence
  dgRNA
  Gm17365
tcgagctaagccttg

SEQ ID NO: 72069 - DNA, 15 bp, Artificial Sequence
  dgRNA
  Gm17365
cgagctaagccttgt

SEQ ID NO: 72070 - DNA, 15 bp, Artificial Sequence
  dgRNA
  Araf
ccacccctcctaatc

SEQ ID NO: 72071 - DNA, 15 bp, Artificial Sequence
  dgRNA
  Araf
cgacccacattccgc

SEQ ID NO: 72072 - DNA, 15 bp, Artificial Sequence
  dgRNA
  Araf
tggccctgtcttgat

SEQ ID NO: 72073 - DNA, 15 bp, Artificial Sequence
  dgRNA
  Araf
aaagcctagggacgg

SEQ ID NO: 72074 - DNA, 15 bp, Artificial Sequence
  dgRNA
  Rala
gcgacacgggaatcc

SEQ ID NO: 72075 - DNA, 15 bp, Artificial Sequence
  dgRNA
  Rala
acgggaatcccggca

SEQ ID NO: 72076 - DNA, 15 bp, Artificial Sequence
  dgRNA
  Rala
atcccggcacggcct

SEQ ID NO: 72077 - DNA, 15 bp, Artificial Sequence
  dgRNA
  Rala
cccggcacggccttg

SEQ ID NO: 72078 - DNA, 15 bp, Artificial Sequence
  dgRNA
  Gpr50
gctgacaccacatag

SEQ ID NO: 72079 - DNA, 15 bp, Artificial Sequence
  dgRNA
  Gpr50
caaggtggtgactaa

SEQ ID NO: 72080 - DNA, 15 bp, Artificial Sequence
  dgRNA
  Gpr50
tcaaggggagtggtt

SEQ ID NO: 72081 - DNA, 15 bp, Artificial Sequence
  dgRNA
  Gpr50
gctagccacccctcg

SEQ ID NO: 72082 - DNA, 15 bp, Artificial Sequence
  dgRNA
  Pbx2
accccagcgcccttt

SEQ ID NO: 72083 - DNA, 15 bp, Artificial Sequence
  dgRNA
  Pbx2
ctctccccggccgcc

SEQ ID NO: 72084 - DNA, 15 bp, Artificial Sequence
  dgRNA
  Pbx2
gtgtctcggccacct

SEQ ID NO: 72085 - DNA, 15 bp, Artificial Sequence
  dgRNA
  Pbx2
ggtgtctcggccacc

SEQ ID NO: 72086 - DNA, 15 bp, Artificial Sequence
  dgRNA
  Rab3d
gtccaagcctccgac

SEQ ID NO: 72087 - DNA, 15 bp, Artificial Sequence
  dgRNA
  Rab3d
gccacgcccatctcc

SEQ ID NO: 72088 - DNA, 15 bp, Artificial Sequence
  dgRNA
  Rab3d
atctcctggctccgt

SEQ ID NO: 72089 - DNA, 15 bp, Artificial Sequence
  dgRNA
  Rab3d
tcctggctccgttgg

SEQ ID NO: 72090 - DNA, 15 bp, Artificial Sequence
  dgRNA
  Msantd3
tgttatctctacgct

SEQ ID NO: 72091 - DNA, 15 bp, Artificial Sequence
  dgRNA
  Msantd3
ttcttcacggatcta

SEQ ID NO: 72092 - DNA, 15 bp, Artificial Sequence
  dgRNA
  Msantd3
aaaccgtcttcatcc

SEQ ID NO: 72093 - DNA, 15 bp, Artificial Sequence
  dgRNA
  Msantd3
aaccgtcttcatcct

SEQ ID NO: 72094 - DNA, 15 bp, Artificial Sequence
  dgRNA
  Ppm1b
atgaccgttttctcc

SEQ ID NO: 72095 - DNA, 15 bp, Artificial Sequence
  dgRNA
  Ppm1b
agtaatcatacccag

SEQ ID NO: 72096 - DNA, 15 bp, Artificial Sequence
  dgRNA
  Ppm1b
gtaatcatacccaga

SEQ ID NO: 72097 - DNA, 15 bp, Artificial Sequence
  dgRNA
  Ppm1b
ctaccattcccagtc

SEQ ID NO: 72098 - DNA, 15 bp, Artificial Sequence
  dgRNA
  Olfr412
gagtagtgtagacta

SEQ ID NO: 72099 - DNA, 15 bp, Artificial Sequence
  dgRNA
  Olfr412
agtagtgtagactat

SEQ ID NO: 72100 - DNA, 15 bp, Artificial Sequence
  dgRNA
  Olfr412
gatacctttaatact

SEQ ID NO: 72101 - DNA, 15 bp, Artificial Sequence
  dgRNA
  Olfr412
cacattgcagacaac

SEQ ID NO: 72102 - DNA, 15 bp, Artificial Sequence
  dgRNA
  Zdhhc7
ctatgtatggtgcgg

SEQ ID NO: 72103 - DNA, 15 bp, Artificial Sequence
  dgRNA
  Zdhhc7
tatgtatggtgcggc

SEQ ID NO: 72104 - DNA, 15 bp, Artificial Sequence
  dgRNA
  Zdhhc7
tcgagtgctctcgaa

SEQ ID NO: 72105 - DNA, 15 bp, Artificial Sequence
  dgRNA
  Zdhhc7
tctcgaacggcaacg

SEQ ID NO: 72106 - DNA, 15 bp, Artificial Sequence
  dgRNA
  8030423J24Rik
taagttgctgaagtt

SEQ ID NO: 72107 - DNA, 15 bp, Artificial Sequence
  dgRNA
  8030423J24Rik
aagaacagaacgtgt

SEQ ID NO: 72108 - DNA, 15 bp, Artificial Sequence
  dgRNA
  8030423J24Rik
tgtaggtaatcgttt

SEQ ID NO: 72109 - DNA, 15 bp, Artificial Sequence
  dgRNA
  8030423J24Rik
gtaggtaatcgtttt

SEQ ID NO: 72110 - DNA, 15 bp, Artificial Sequence
  dgRNA
  Borcs5
attaatgtgtcttcg

SEQ ID NO: 72111 - DNA, 15 bp, Artificial Sequence
  dgRNA
  Borcs5
ttaatgtgtcttcgg

SEQ ID NO: 72112 - DNA, 15 bp, Artificial Sequence
  dgRNA
  Borcs5
ttcgggggtaggaaa

SEQ ID NO: 72113 - DNA, 15 bp, Artificial Sequence
  dgRNA
  Borcs5
aagcctagcccttta

SEQ ID NO: 72114 - DNA, 15 bp, Artificial Sequence
  dgRNA
  Nr5a1
ggcccccataaagat

SEQ ID NO: 72115 - DNA, 15 bp, Artificial Sequence
  dgRNA
  Nr5a1
gcccccataaagata

SEQ ID NO: 72116 - DNA, 15 bp, Artificial Sequence
  dgRNA
  Nr5a1
cctgcagagtcacgt

SEQ ID NO: 72117 - DNA, 15 bp, Artificial Sequence
  dgRNA
  Nr5a1
ctgcagagtcacgtg

SEQ ID NO: 72118 - DNA, 15 bp, Artificial Sequence
  dgRNA
  Acad12
ggacgagcccaccgg

SEQ ID NO: 72119 - DNA, 15 bp, Artificial Sequence
  dgRNA
  Acad12
agcggcagccccaag

SEQ ID NO: 72120 - DNA, 15 bp, Artificial Sequence
  dgRNA
  Acad12
tccgcttccgtctgt

SEQ ID NO: 72121 - DNA, 15 bp, Artificial Sequence
  dgRNA
  Acad12
cgtctctgacccgcg

SEQ ID NO: 72122 - DNA, 15 bp, Artificial Sequence
  dgRNA
  14-Sep
gctggtataagaact

SEQ ID NO: 72123 - DNA, 15 bp, Artificial Sequence
  dgRNA
  14-Sep
tcttataccagcatg

SEQ ID NO: 72124 - DNA, 15 bp, Artificial Sequence
  dgRNA
  Shisa7
ggggtctcctccagg

SEQ ID NO: 72125 - DNA, 15 bp, Artificial Sequence
  dgRNA
  Shisa7
ctccaagctccaagc

SEQ ID NO: 72126 - DNA, 15 bp, Artificial Sequence
  dgRNA
  Shisa7
gccggcgcgagacac

SEQ ID NO: 72127 - DNA, 15 bp, Artificial Sequence
  dgRNA
  Shisa7
cgcgagacacaggcg

SEQ ID NO: 72128 - DNA, 15 bp, Artificial Sequence
  dgRNA
  Trpv2
gtatgttattatagg

SEQ ID NO: 72129 - DNA, 15 bp, Artificial Sequence
  dgRNA
  Trpv2
taggagtacgtttct

SEQ ID NO: 72130 - DNA, 15 bp, Artificial Sequence
  dgRNA
  Trpv2
aggagtacgtttcta

SEQ ID NO: 72131 - DNA, 15 bp, Artificial Sequence
  dgRNA
  Trpv2
agtttagggtctagc

SEQ ID NO: 72132 - DNA, 15 bp, Artificial Sequence
  dgRNA
  Efnb3
cgtgagagaccgcgc

SEQ ID NO: 72133 - DNA, 15 bp, Artificial Sequence
  dgRNA
  Efnb3
gtgagagaccgcgcc

SEQ ID NO: 72134 - DNA, 15 bp, Artificial Sequence
  dgRNA
  Efnb3
ccgcgccgggcagcg

SEQ ID NO: 72135 - DNA, 15 bp, Artificial Sequence
  dgRNA
  Efnb3
cgccgggcagcgagg

SEQ ID NO: 72136 - DNA, 15 bp, Artificial Sequence
  dgRNA
  Pcca
tggtcggctccctcc

SEQ ID NO: 72137 - DNA, 15 bp, Artificial Sequence
  dgRNA
  Pcca
ctccgggtcctagtg

SEQ ID NO: 72138 - DNA, 15 bp, Artificial Sequence
  dgRNA
  Pcca
atatgcgtaagccct

SEQ ID NO: 72139 - DNA, 15 bp, Artificial Sequence
  dgRNA
  Pcca
taagccctaggcgac

SEQ ID NO: 72140 - DNA, 15 bp, Artificial Sequence
  dgRNA
  Capn13
actgtttaactaagg

SEQ ID NO: 72141 - DNA, 15 bp, Artificial Sequence
  dgRNA
  Capn13
ctgtttaactaaggt

SEQ ID NO: 72142 - DNA, 15 bp, Artificial Sequence
  dgRNA
  Capn13
tgtttaactaaggtg

SEQ ID NO: 72143 - DNA, 15 bp, Artificial Sequence
  dgRNA
  Capn13
agctgcacctatata

SEQ ID NO: 72144 - DNA, 15 bp, Artificial Sequence
  dgRNA
  Fam228a
cactcctacaaattg

SEQ ID NO: 72145 - DNA, 15 bp, Artificial Sequence
  dgRNA
  Fam228a
ctcctacaaattgag

SEQ ID NO: 72146 - DNA, 15 bp, Artificial Sequence
  dgRNA
  Fam228a
ggaaacgcctctgaa

SEQ ID NO: 72147 - DNA, 15 bp, Artificial Sequence
  dgRNA
  Fam228a
cgcctctgaaaggca

SEQ ID NO: 72148 - DNA, 15 bp, Artificial Sequence
  dgRNA
  Stfa3
caatatctgagggac

SEQ ID NO: 72149 - DNA, 15 bp, Artificial Sequence
  dgRNA
  Slfn3
aatccctagagtgcc

SEQ ID NO: 72150 - DNA, 15 bp, Artificial Sequence
  dgRNA
  Slfn3
tcaccggagctgggc

SEQ ID NO: 72151 - DNA, 15 bp, Artificial Sequence
  dgRNA
  Slfn3
tctagggattatgca

SEQ ID NO: 72152 - DNA, 15 bp, Artificial Sequence
  dgRNA
  Slfn3
agctccggtgagggt

SEQ ID NO: 72153 - DNA, 15 bp, Artificial Sequence
  dgRNA
  1700123K08Rik
actgttaagcaagta

SEQ ID NO: 72154 - DNA, 15 bp, Artificial Sequence
  dgRNA
  Snn
cccattgtgcgcctc

SEQ ID NO: 72155 - DNA, 15 bp, Artificial Sequence
  dgRNA
  Snn
ccattgtgcgcctcc

SEQ ID NO: 72156 - DNA, 15 bp, Artificial Sequence
  dgRNA
  Snn
agcgcgatctccagt

SEQ ID NO: 72157 - DNA, 15 bp, Artificial Sequence
  dgRNA
  Snn
ccttgagcgcttatt

SEQ ID NO: 72158 - DNA, 15 bp, Artificial Sequence
  dgRNA
  Olfr211
actagtagatgatta

SEQ ID NO: 72159 - DNA, 15 bp, Artificial Sequence
  dgRNA
  Nxpe3
cgccccgcccatagt

SEQ ID NO: 72160 - DNA, 15 bp, Artificial Sequence
  dgRNA
  Nxpe3
cggaccaatcgtagc

SEQ ID NO: 72161 - DNA, 15 bp, Artificial Sequence
  dgRNA
  Nxpe3
ggaccaatcgtagcc

SEQ ID NO: 72162 - DNA, 15 bp, Artificial Sequence
  dgRNA
  Nxpe3
gaccaatcgtagccg

SEQ ID NO: 72163 - DNA, 15 bp, Artificial Sequence
  dgRNA
  Lyg1
tgggtgcagaatgcc

SEQ ID NO: 72164 - DNA, 15 bp, Artificial Sequence
  dgRNA
  Lyg1
atgagaccctatata

SEQ ID NO: 72165 - DNA, 15 bp, Artificial Sequence
  dgRNA
  Lyg1
tattcaagaatgtcc

SEQ ID NO: 72166 - DNA, 15 bp, Artificial Sequence
  dgRNA
  Lyg1
actttgaactcatat

SEQ ID NO: 72167 - DNA, 15 bp, Artificial Sequence
  dgRNA
  Pigq
ggtagctttgatgac

SEQ ID NO: 72168 - DNA, 15 bp, Artificial Sequence
  dgRNA
  Pigq
caggagccgcgcgcg

SEQ ID NO: 72169 - DNA, 15 bp, Artificial Sequence
  dgRNA
  Pigq
cgcgcgcggaactct

SEQ ID NO: 72170 - DNA, 15 bp, Artificial Sequence
  dgRNA
  Pigq
ggaactctcgggctc

SEQ ID NO: 72171 - DNA, 15 bp, Artificial Sequence
  dgRNA
  Ssh2
gcccccttacccagg

SEQ ID NO: 72172 - DNA, 15 bp, Artificial Sequence
  dgRNA
  Ssh2
ggcccgtaagcgttg

SEQ ID NO: 72173 - DNA, 15 bp, Artificial Sequence
  dgRNA
  Ssh2
gcccgtaagcgttga

SEQ ID NO: 72174 - DNA, 15 bp, Artificial Sequence
  dgRNA
  Ssh2
gttgagggatccgcg

SEQ ID NO: 72175 - DNA, 15 bp, Artificial Sequence
  dgRNA
  Pawr
ttctccgcccccttt

SEQ ID NO: 72176 - DNA, 15 bp, Artificial Sequence
  dgRNA
  Pawr
tctccgccccctttc

SEQ ID NO: 72177 - DNA, 15 bp, Artificial Sequence
  dgRNA
  Pawr
cccctttcgggccgc

SEQ ID NO: 72178 - DNA, 15 bp, Artificial Sequence
  dgRNA
  Pawr
ccctttcgggccgca

SEQ ID NO: 72179 - DNA, 15 bp, Artificial Sequence
  dgRNA
  Pkn3
tgaagtgcagtagac

SEQ ID NO: 72180 - DNA, 15 bp, Artificial Sequence
  dgRNA
  Pkn3
agcaccgcagccctc

SEQ ID NO: 72181 - DNA, 15 bp, Artificial Sequence
  dgRNA
  Pkn3
tccggagatccttct

SEQ ID NO: 72182 - DNA, 15 bp, Artificial Sequence
  dgRNA
  Pkn3
cctgacttgacacta

SEQ ID NO: 72183 - DNA, 15 bp, Artificial Sequence
  dgRNA
  Pvr
cgggatgatctcacg

SEQ ID NO: 72184 - DNA, 15 bp, Artificial Sequence
  dgRNA
  Pvr
ctccccacccgactc

SEQ ID NO: 72185 - DNA, 15 bp, Artificial Sequence
  dgRNA
  Pvr
acccgactcaggtgc

SEQ ID NO: 72186 - DNA, 15 bp, Artificial Sequence
  dgRNA
  Pvr
cccgactcaggtgct

SEQ ID NO: 72187 - DNA, 15 bp, Artificial Sequence
  dgRNA
  Pqbp1
tattggctagccaga

SEQ ID NO: 72188 - DNA, 15 bp, Artificial Sequence
  dgRNA
  Pqbp1
gttccatgtaagcgt

SEQ ID NO: 72189 - DNA, 15 bp, Artificial Sequence
  dgRNA
  Pqbp1
ccagttaattgcacc

SEQ ID NO: 72190 - DNA, 15 bp, Artificial Sequence
  dgRNA
  Pqbp1
cagttaattgcacct

SEQ ID NO: 72191 - DNA, 15 bp, Artificial Sequence
  dgRNA
  Mgme1
caacgcgcggcttga

SEQ ID NO: 72192 - DNA, 15 bp, Artificial Sequence
  dgRNA
  Mgme1
cccgcgcttctgctt

SEQ ID NO: 72193 - DNA, 15 bp, Artificial Sequence
  dgRNA
  Mgme1
cgcgcttctgcttcg

SEQ ID NO: 72194 - DNA, 15 bp, Artificial Sequence
  dgRNA
  Mgme1
gcgcttctgcttcgg

SEQ ID NO: 72195 - DNA, 15 bp, Artificial Sequence
  dgRNA
  Fam84a
cagggcggagcacaa

SEQ ID NO: 72196 - DNA, 15 bp, Artificial Sequence
  dgRNA
  Fam84a
acccccagccgagat

SEQ ID NO: 72197 - DNA, 15 bp, Artificial Sequence
  dgRNA
  Fam84a
ccagccgagattggc

SEQ ID NO: 72198 - DNA, 15 bp, Artificial Sequence
  dgRNA
  Fam84a
cagccgagattggca

SEQ ID NO: 72199 - DNA, 15 bp, Artificial Sequence
  dgRNA
  Cox7a2
agacaagctactttc

SEQ ID NO: 72200 - DNA, 15 bp, Artificial Sequence
  dgRNA
  Cox7a2
gacaagctactttcc

SEQ ID NO: 72201 - DNA, 15 bp, Artificial Sequence
  dgRNA
  Cox7a2
actttccgggtagtc

SEQ ID NO: 72202 - DNA, 15 bp, Artificial Sequence
  dgRNA
  Cox7a2
ccagagcgtatgaag

SEQ ID NO: 72203 - DNA, 15 bp, Artificial Sequence
  dgRNA
  Ficd
acaagcgacagccaa

SEQ ID NO: 72204 - DNA, 15 bp, Artificial Sequence
  dgRNA
  Ficd
acggcgcgcctttcc

SEQ ID NO: 72205 - DNA, 15 bp, Artificial Sequence
  dgRNA
  Ficd
cggcgcgcctttccc

SEQ ID NO: 72206 - DNA, 15 bp, Artificial Sequence
  dgRNA
  Ficd
ggcgcgcctttcccg

SEQ ID NO: 72207 - DNA, 15 bp, Artificial Sequence
  dgRNA
  Zfp553
cctggttgtcccgcg

SEQ ID NO: 72208 - DNA, 15 bp, Artificial Sequence
  dgRNA
  Zfp553
ctggttgtcccgcgc

SEQ ID NO: 72209 - DNA, 15 bp, Artificial Sequence
  dgRNA
  Zfp553
cccgcgcgggcagtc

SEQ ID NO: 72210 - DNA, 15 bp, Artificial Sequence
  dgRNA
  Zfp553
ccagctgtccatccg

SEQ ID NO: 72211 - DNA, 15 bp, Artificial Sequence
  dgRNA
  Nudt5
taggttacctcttga

SEQ ID NO: 72212 - DNA, 15 bp, Artificial Sequence
  dgRNA
  Nudt5
tacctcttgatggta

SEQ ID NO: 72213 - DNA, 15 bp, Artificial Sequence
  dgRNA
  Nudt5
aaggcttcggaaaag

SEQ ID NO: 72214 - DNA, 15 bp, Artificial Sequence
  dgRNA
  Nudt5
aggcttcggaaaagt

SEQ ID NO: 72215 - DNA, 15 bp, Artificial Sequence
  dgRNA
  Sub1
gtggcggccccttta

SEQ ID NO: 72216 - DNA, 15 bp, Artificial Sequence
  dgRNA
  Sub1
ctggaaagggccggc

SEQ ID NO: 72217 - DNA, 15 bp, Artificial Sequence
  dgRNA
  Sub1
gaaagggccggctgg

SEQ ID NO: 72218 - DNA, 15 bp, Artificial Sequence
  dgRNA
  Sub1
gggccggctggcggt

SEQ ID NO: 72219 - DNA, 15 bp, Artificial Sequence
  dgRNA
  Arhgap20
aaagcttcgtacccg

SEQ ID NO: 72220 - DNA, 15 bp, Artificial Sequence
  dgRNA
  Arhgap20
gcttcgtacccgcgg

SEQ ID NO: 72221 - DNA, 15 bp, Artificial Sequence
  dgRNA
  Arhgap20
cggaggcacctcgca

SEQ ID NO: 72222 - DNA, 15 bp, Artificial Sequence
  dgRNA
  Arhgap20
acctcgcaaggttag

SEQ ID NO: 72223 - DNA, 15 bp, Artificial Sequence
  dgRNA
  Crim1
ccggggcagccccgg

SEQ ID NO: 72224 - DNA, 15 bp, Artificial Sequence
  dgRNA
  Crim1
cggggcagccccgga

SEQ ID NO: 72225 - DNA, 15 bp, Artificial Sequence
  dgRNA
  Crim1
ccggagggaggcgag

SEQ ID NO: 72226 - DNA, 15 bp, Artificial Sequence
  dgRNA
  Crim1
gggccggccggcccg

SEQ ID NO: 72227 - DNA, 15 bp, Artificial Sequence
  dgRNA
  Stac
tcactagacccagcg

SEQ ID NO: 72228 - DNA, 15 bp, Artificial Sequence
  dgRNA
  Stac
cactagacccagcgc

SEQ ID NO: 72229 - DNA, 15 bp, Artificial Sequence
  dgRNA
  Stac
cgcgggcgctcagcg

SEQ ID NO: 72230 - DNA, 15 bp, Artificial Sequence
  dgRNA
  Stac
cccacactgtcggag

SEQ ID NO: 72231 - DNA, 15 bp, Artificial Sequence
  dgRNA
  Plcb2
gggggaggaactccc

SEQ ID NO: 72232 - DNA, 15 bp, Artificial Sequence
  dgRNA
  Plcb2
gcagcccccggcttc

SEQ ID NO: 72233 - DNA, 15 bp, Artificial Sequence
  dgRNA
  Plcb2
gcccccggcttcagg

SEQ ID NO: 72234 - DNA, 15 bp, Artificial Sequence
  dgRNA
  Plcb2
agatcaactgggccc

SEQ ID NO: 72235 - DNA, 15 bp, Artificial Sequence
  dgRNA
  Mettl11b
attcagggtgttagc

SEQ ID NO: 72236 - DNA, 15 bp, Artificial Sequence
  dgRNA
  Mettl11b
aagcgtgcttttccc

SEQ ID NO: 72237 - DNA, 15 bp, Artificial Sequence
  dgRNA
  Mettl11b
ttccccggatgaagc

SEQ ID NO: 72238 - DNA, 15 bp, Artificial Sequence
  dgRNA
  Mettl11b
acttttagcacctgc

SEQ ID NO: 72239 - DNA, 15 bp, Artificial Sequence
  dgRNA
  Ier5l
gcggcgttggaggcc

SEQ ID NO: 72240 - DNA, 15 bp, Artificial Sequence
  dgRNA
  Ier5l
cggcgttggaggccc

SEQ ID NO: 72241 - DNA, 15 bp, Artificial Sequence
  dgRNA
  Ier5l
ggcgttggaggcccg

SEQ ID NO: 72242 - DNA, 15 bp, Artificial Sequence
  dgRNA
  Ier5l
acaaaggaaccgcct

SEQ ID NO: 72243 - DNA, 15 bp, Artificial Sequence
  dgRNA
  Mphosph9
gcacgcacgcgcgtc

SEQ ID NO: 72244 - DNA, 15 bp, Artificial Sequence
  dgRNA
  Mphosph9
cacgcacgcgcgtca

SEQ ID NO: 72245 - DNA, 15 bp, Artificial Sequence
  dgRNA
  Mphosph9
acgcacgcgcgtcag

SEQ ID NO: 72246 - DNA, 15 bp, Artificial Sequence
  dgRNA
  Mphosph9
gcgtcaggggaaact

SEQ ID NO: 72247 - DNA, 15 bp, Artificial Sequence
  dgRNA
  Zfp677
tgtcttccacgggga

SEQ ID NO: 72248 - DNA, 15 bp, Artificial Sequence
  dgRNA
  Zfp677
ttccacggggacggg

SEQ ID NO: 72249 - DNA, 15 bp, Artificial Sequence
  dgRNA
  Zfp677
tccacggggacgggc

SEQ ID NO: 72250 - DNA, 15 bp, Artificial Sequence
  dgRNA
  Zfp677
ccacggggacgggcg

SEQ ID NO: 72251 - DNA, 15 bp, Artificial Sequence
  dgRNA
  Lpin3
cgtccatgaaagcac

SEQ ID NO: 72252 - DNA, 15 bp, Artificial Sequence
  dgRNA
  Lpin3
gtgtcctaaacagca

SEQ ID NO: 72253 - DNA, 15 bp, Artificial Sequence
  dgRNA
  Lpin3
ctcagctagtcactc

SEQ ID NO: 72254 - DNA, 15 bp, Artificial Sequence
  dgRNA
  Lpin3
tcagctagtcactca

SEQ ID NO: 72255 - DNA, 15 bp, Artificial Sequence
  dgRNA
  Kbtbd3
gctccaccccttttc

SEQ ID NO: 72256 - DNA, 15 bp, Artificial Sequence
  dgRNA
  Kbtbd3
tctgtgcgaagtagc

SEQ ID NO: 72257 - DNA, 15 bp, Artificial Sequence
  dgRNA
  Kbtbd3
aagtagctggacgcc

SEQ ID NO: 72258 - DNA, 15 bp, Artificial Sequence
  dgRNA
  Kbtbd3
ccccacctttagttc

SEQ ID NO: 72259 - DNA, 15 bp, Artificial Sequence
  dgRNA
  Meaf6
gcagggtccgcctac

SEQ ID NO: 72260 - DNA, 15 bp, Artificial Sequence
  dgRNA
  Meaf6
cgcgcgaccagtagg

SEQ ID NO: 72261 - DNA, 15 bp, Artificial Sequence
  dgRNA
  Meaf6
cggcgcgcgaccagt

SEQ ID NO: 72262 - DNA, 15 bp, Artificial Sequence
  dgRNA
  Mrgpre
ctgcctgaaattgcc

SEQ ID NO: 72263 - DNA, 15 bp, Artificial Sequence
  dgRNA
  Mrgpre
tgcctgaaattgcca

SEQ ID NO: 72264 - DNA, 15 bp, Artificial Sequence
  dgRNA
  Mrgpre
tctctaaagggcccc

SEQ ID NO: 72265 - DNA, 15 bp, Artificial Sequence
  dgRNA
  Mrgpre
ctctaaagggcccct

SEQ ID NO: 72266 - DNA, 15 bp, Artificial Sequence
  dgRNA
  Emb
aacccatccaacgga

SEQ ID NO: 72267 - DNA, 15 bp, Artificial Sequence
  dgRNA
  Emb
agttgcaacccctcc

SEQ ID NO: 72268 - DNA, 15 bp, Artificial Sequence
  dgRNA
  Emb
tgcaacccctccggg

SEQ ID NO: 72269 - DNA, 15 bp, Artificial Sequence
  dgRNA
  Emb
ccctccgggaggtga

SEQ ID NO: 72270 - DNA, 15 bp, Artificial Sequence
  dgRNA
  Zfp599
aaattcaccaatggt

SEQ ID NO: 72271 - DNA, 15 bp, Artificial Sequence
  dgRNA
  Zfp599
catttaaggttgaga

SEQ ID NO: 72272 - DNA, 15 bp, Artificial Sequence
  dgRNA
  Zfp599
gctgtattgtaaggc

SEQ ID NO: 72273 - DNA, 15 bp, Artificial Sequence
  dgRNA
  Zfp599
cttggctgtattgta

SEQ ID NO: 72274 - DNA, 15 bp, Artificial Sequence
  dgRNA
  Pcp4l1
cgtcttaccctagtt

SEQ ID NO: 72275 - DNA, 15 bp, Artificial Sequence
  dgRNA
  Pcp4l1
tgagcctgccaccac

SEQ ID NO: 72276 - DNA, 15 bp, Artificial Sequence
  dgRNA
  Pcp4l1
ttctattggttgggc

SEQ ID NO: 72277 - DNA, 15 bp, Artificial Sequence
  dgRNA
  Pcp4l1
tattggttgggctgg

SEQ ID NO: 72278 - DNA, 15 bp, Artificial Sequence
  dgRNA
  Gab2
gcgcgcgcggccgga

SEQ ID NO: 72279 - DNA, 15 bp, Artificial Sequence
  dgRNA
  Gab2
cgcgcggccggaggg

SEQ ID NO: 72280 - DNA, 15 bp, Artificial Sequence
  dgRNA
  Gab2
cgcggccggagggcg

SEQ ID NO: 72281 - DNA, 15 bp, Artificial Sequence
  dgRNA
  Gab2
aactcgagcgcgcgc

SEQ ID NO: 72282 - DNA, 15 bp, Artificial Sequence
  dgRNA
  4930504O13Rik
gccaagactccgaga

SEQ ID NO: 72283 - DNA, 15 bp, Artificial Sequence
  dgRNA
  4930504O13Rik
gcgcgcaatgcagtt

SEQ ID NO: 72284 - DNA, 15 bp, Artificial Sequence
  dgRNA
  4930504O13Rik
gccttctcggagtct

SEQ ID NO: 72285 - DNA, 15 bp, Artificial Sequence
  dgRNA
  4930504O13Rik
cgtgtggtgcggagg

SEQ ID NO: 72286 - DNA, 15 bp, Artificial Sequence
  dgRNA
  C4bp
gtccccttctaactt

SEQ ID NO: 72287 - DNA, 15 bp, Artificial Sequence
  dgRNA
  C4bp
ccccttctaacttag

SEQ ID NO: 72288 - DNA, 15 bp, Artificial Sequence
  dgRNA
  C4bp
tgttaatcattcacc

SEQ ID NO: 72289 - DNA, 15 bp, Artificial Sequence
  dgRNA
  C4bp
cattcaccgggacag

SEQ ID NO: 72290 - DNA, 15 bp, Artificial Sequence
  dgRNA
  Gpr151
ccaaccagcaaaggg

SEQ ID NO: 72291 - DNA, 15 bp, Artificial Sequence
  dgRNA
  Gpr151
accagccccataaag

SEQ ID NO: 72292 - DNA, 15 bp, Artificial Sequence
  dgRNA
  Gpr151
agtgcacggaatgac

SEQ ID NO: 72293 - DNA, 15 bp, Artificial Sequence
  dgRNA
  Supt4a
tcgctctcgcgaacc

SEQ ID NO: 72294 - DNA, 15 bp, Artificial Sequence
  dgRNA
  Supt4a
tcgcgaaccaggtga

SEQ ID NO: 72295 - DNA, 15 bp, Artificial Sequence
  dgRNA
  Supt4a
cgcgaaccaggtgac

SEQ ID NO: 72296 - DNA, 15 bp, Artificial Sequence
  dgRNA
  Supt4a
tgacgggcgcgcgcg

SEQ ID NO: 72297 - DNA, 15 bp, Artificial Sequence
  dgRNA
  Csf3r
ctgagcctcaaagcg

SEQ ID NO: 72298 - DNA, 15 bp, Artificial Sequence
  dgRNA
  Csf3r
caaagcgaggagctc

SEQ ID NO: 72299 - DNA, 15 bp, Artificial Sequence
  dgRNA
  Csf3r
atccggagagaaggg

SEQ ID NO: 72300 - DNA, 15 bp, Artificial Sequence
  dgRNA
  Csf3r
caggacaaaatagcg

SEQ ID NO: 72301 - DNA, 15 bp, Artificial Sequence
  dgRNA
  Slc22a4
ccggccgattccggg

SEQ ID NO: 72302 - DNA, 15 bp, Artificial Sequence
  dgRNA
  Slc22a4
ccgattccgggcggg

SEQ ID NO: 72303 - DNA, 15 bp, Artificial Sequence
  dgRNA
  Slc22a4
tgcgtggaaggccgc

SEQ ID NO: 72304 - DNA, 15 bp, Artificial Sequence
  dgRNA
  Slc22a4
gcgtggaaggccgct

SEQ ID NO: 72305 - DNA, 15 bp, Artificial Sequence
  dgRNA
  Sh3kbp1
cctgtgccagagatt

SEQ ID NO: 72306 - DNA, 15 bp, Artificial Sequence
  dgRNA
  Sh3kbp1
caggaggcttgacta

SEQ ID NO: 72307 - DNA, 15 bp, Artificial Sequence
  dgRNA
  Sh3kbp1
aggaggcttgactat

SEQ ID NO: 72308 - DNA, 15 bp, Artificial Sequence
  dgRNA
  Sh3kbp1
gcttgactatgggac

SEQ ID NO: 72309 - DNA, 15 bp, Artificial Sequence
  dgRNA
  Eri3
ccttaacgcgcatgt

SEQ ID NO: 72310 - DNA, 15 bp, Artificial Sequence
  dgRNA
  Eri3
taacgcgcatgtcgg

SEQ ID NO: 72311 - DNA, 15 bp, Artificial Sequence
  dgRNA
  Eri3
aacgcgcatgtcggc

SEQ ID NO: 72312 - DNA, 15 bp, Artificial Sequence
  dgRNA
  Eri3
caaaggcgctagcag

SEQ ID NO: 72313 - DNA, 15 bp, Artificial Sequence
  dgRNA
  Zfp809
ccttccgtcatcgat

SEQ ID NO: 72314 - DNA, 15 bp, Artificial Sequence
  dgRNA
  Zfp809
gaccgctctgaaatg

SEQ ID NO: 72315 - DNA, 15 bp, Artificial Sequence
  dgRNA
  Zfp809
tagcggacagaaaaa

SEQ ID NO: 72316 - DNA, 15 bp, Artificial Sequence
  dgRNA
  Zfp809
ggctgtctgatcata

SEQ ID NO: 72317 - DNA, 15 bp, Artificial Sequence
  dgRNA
  Upp2
gcaaataaggctggg

SEQ ID NO: 72318 - DNA, 15 bp, Artificial Sequence
  dgRNA
  Upp2
acacctgtcctacgt

SEQ ID NO: 72319 - DNA, 15 bp, Artificial Sequence
  dgRNA
  Upp2
cacctgtcctacgtt

SEQ ID NO: 72320 - DNA, 15 bp, Artificial Sequence
  dgRNA
  Upp2
cctacgttgggacca

SEQ ID NO: 72321 - DNA, 15 bp, Artificial Sequence
  dgRNA
  1110037F02Rik
cgccctccgccgcgc

SEQ ID NO: 72322 - DNA, 15 bp, Artificial Sequence
  dgRNA
  1110037F02Rik
cctccgccgcgctgg

SEQ ID NO: 72323 - DNA, 15 bp, Artificial Sequence
  dgRNA
  1110037F02Rik
ccgccgcgctggagg

SEQ ID NO: 72324 - DNA, 15 bp, Artificial Sequence
  dgRNA
  1110037F02Rik
cgcgctggaggaggc

SEQ ID NO: 72325 - DNA, 15 bp, Artificial Sequence
  dgRNA
  Ank2
tgcctctttgggacg

SEQ ID NO: 72326 - DNA, 15 bp, Artificial Sequence
  dgRNA
  Ank2
ctccgcgtcccaaag

SEQ ID NO: 72327 - DNA, 15 bp, Artificial Sequence
  dgRNA
  Prrg2
cccctcgccagtagc

SEQ ID NO: 72328 - DNA, 15 bp, Artificial Sequence
  dgRNA
  Prrg2
cgccagtagccggct

SEQ ID NO: 72329 - DNA, 15 bp, Artificial Sequence
  dgRNA
  Prrg2
gccagtagccggctc

SEQ ID NO: 72330 - DNA, 15 bp, Artificial Sequence
  dgRNA
  Prrg2
cgggcctagtaaccc

SEQ ID NO: 72331 - DNA, 15 bp, Artificial Sequence
  dgRNA
  Stt3a
ttcgctttcccgcgc

SEQ ID NO: 72332 - DNA, 15 bp, Artificial Sequence
  dgRNA
  Stt3a
cggcctatcacagtt

SEQ ID NO: 72333 - DNA, 15 bp, Artificial Sequence
  dgRNA
  Stt3a
cctatcacagttcgg

SEQ ID NO: 72334 - DNA, 15 bp, Artificial Sequence
  dgRNA
  Stt3a
ctatcacagttcggt

SEQ ID NO: 72335 - DNA, 15 bp, Artificial Sequence
  dgRNA
  Eml2
gtccgggctccaccc

SEQ ID NO: 72336 - DNA, 15 bp, Artificial Sequence
  dgRNA
  Eml2
gggtggagcccggac

SEQ ID NO: 72337 - DNA, 15 bp, Artificial Sequence
  dgRNA
  Eml2
gcttcgggtccgggg

SEQ ID NO: 72338 - DNA, 15 bp, Artificial Sequence
  dgRNA
  Eml2
ggagcttcgggtccg

SEQ ID NO: 72339 - DNA, 15 bp, Artificial Sequence
  dgRNA
  Phgdh
gtgttaaagctcacc

SEQ ID NO: 72340 - DNA, 15 bp, Artificial Sequence
  dgRNA
  Phgdh
tgttaaagctcaccc

SEQ ID NO: 72341 - DNA, 15 bp, Artificial Sequence
  dgRNA
  Phgdh
gttaaagctcacccg

SEQ ID NO: 72342 - DNA, 15 bp, Artificial Sequence
  dgRNA
  Phgdh
aagctcacccggggc

SEQ ID NO: 72343 - DNA, 15 bp, Artificial Sequence
  dgRNA
  Terf2
ccagaagcccgcggg

SEQ ID NO: 72344 - DNA, 15 bp, Artificial Sequence
  dgRNA
  Terf2
agcccgcgggcggct

SEQ ID NO: 72345 - DNA, 15 bp, Artificial Sequence
  dgRNA
  Terf2
cgcgggcttctggga

SEQ ID NO: 72346 - DNA, 15 bp, Artificial Sequence
  dgRNA
  Terf2
ccgcgggcttctggg

SEQ ID NO: 72347 - DNA, 15 bp, Artificial Sequence
  dgRNA
  Evl
actctgcacaaattg

SEQ ID NO: 72348 - DNA, 15 bp, Artificial Sequence
  dgRNA
  Evl
ctgcacaaattgtgg

SEQ ID NO: 72349 - DNA, 15 bp, Artificial Sequence
  dgRNA
  Evl
ttacttgatttaccc

SEQ ID NO: 72350 - DNA, 15 bp, Artificial Sequence
  dgRNA
  Evl
atcctaagcgcaccc

SEQ ID NO: 72351 - DNA, 15 bp, Artificial Sequence
  dgRNA
  Lypd1
actcccgaacccagc

SEQ ID NO: 72352 - DNA, 15 bp, Artificial Sequence
  dgRNA
  Lypd1
aggcgctcctttcca

SEQ ID NO: 72353 - DNA, 15 bp, Artificial Sequence
  dgRNA
  Lypd1
tcagcagccgtcacg

SEQ ID NO: 72354 - DNA, 15 bp, Artificial Sequence
  dgRNA
  Lypd1
ccgtcacgtggtacc

SEQ ID NO: 72355 - DNA, 15 bp, Artificial Sequence
  dgRNA
  Lyst
ctccacgcatcacgt

SEQ ID NO: 72356 - DNA, 15 bp, Artificial Sequence
  dgRNA
  Lyst
agcgtgccctcccgg

SEQ ID NO: 72357 - DNA, 15 bp, Artificial Sequence
  dgRNA
  Lyst
gcgtgccctcccggt

SEQ ID NO: 72358 - DNA, 15 bp, Artificial Sequence
  dgRNA
  Lyst
cgtgccctcccggtg

SEQ ID NO: 72359 - DNA, 15 bp, Artificial Sequence
  dgRNA
  Myh2
cgctcgattgccaag

SEQ ID NO: 72360 - DNA, 15 bp, Artificial Sequence
  dgRNA
  Myh2
gctcgattgccaaga

SEQ ID NO: 72361 - DNA, 15 bp, Artificial Sequence
  dgRNA
  Myh2
tggcaaaaaccctct

SEQ ID NO: 72362 - DNA, 15 bp, Artificial Sequence
  dgRNA
  Kcnk18
ccccgccagaaactc

SEQ ID NO: 72363 - DNA, 15 bp, Artificial Sequence
  dgRNA
  Kcnk18
ggatcaataacaatt

SEQ ID NO: 72364 - DNA, 15 bp, Artificial Sequence
  dgRNA
  Kcnk18
tttggggcactagca

SEQ ID NO: 72365 - DNA, 15 bp, Artificial Sequence
  dgRNA
  Kcnk18
ttggggcactagcag

SEQ ID NO: 72366 - DNA, 15 bp, Artificial Sequence
  dgRNA
  Tnni3k
gatcgtgtagtggct

SEQ ID NO: 72367 - DNA, 15 bp, Artificial Sequence
  dgRNA
  Tnni3k
gagctgatcgtgtag

SEQ ID NO: 72368 - DNA, 15 bp, Artificial Sequence
  dgRNA
  Tnni3k
atggaatgtcatgca

SEQ ID NO: 72369 - DNA, 15 bp, Artificial Sequence
  dgRNA
  G2e3
aagcgaggaactttt

SEQ ID NO: 72370 - DNA, 15 bp, Artificial Sequence
  dgRNA
  G2e3
aacttttaggacaat

SEQ ID NO: 72371 - DNA, 15 bp, Artificial Sequence
  dgRNA
  G2e3
aattccttgcgggag

SEQ ID NO: 72372 - DNA, 15 bp, Artificial Sequence
  dgRNA
  G2e3
attccttgcgggaga

SEQ ID NO: 72373 - DNA, 15 bp, Artificial Sequence
  dgRNA
  Wrap73
ccccgggtaactttt

SEQ ID NO: 72374 - DNA, 15 bp, Artificial Sequence
  dgRNA
  Wrap73
ttcagccttccgttt

SEQ ID NO: 72375 - DNA, 15 bp, Artificial Sequence
  dgRNA
  Wrap73
cgtttcgggatttgc

SEQ ID NO: 72376 - DNA, 15 bp, Artificial Sequence
  dgRNA
  Wrap73
gtttcgggatttgca

SEQ ID NO: 72377 - DNA, 15 bp, Artificial Sequence
  dgRNA
  Cpb1
caaaataactgtgcc

SEQ ID NO: 72378 - DNA, 15 bp, Artificial Sequence
  dgRNA
  Cpb1
atcaagatctgatag

SEQ ID NO: 72379 - DNA, 15 bp, Artificial Sequence
  dgRNA
  Cpb1
tagaatcattagtgt

SEQ ID NO: 72380 - DNA, 15 bp, Artificial Sequence
  dgRNA
  Cpb1
cacagttattttggt

SEQ ID NO: 72381 - DNA, 15 bp, Artificial Sequence
  dgRNA
  Gmeb1
ccttattcagtcccc

SEQ ID NO: 72382 - DNA, 15 bp, Artificial Sequence
  dgRNA
  Gmeb1
ccaggggactgaata

SEQ ID NO: 72383 - DNA, 15 bp, Artificial Sequence
  dgRNA
  Gmeb1
cgcgggaggccccag

SEQ ID NO: 72384 - DNA, 15 bp, Artificial Sequence
  dgRNA
  Gmeb1
tcgcgggaggcccca

SEQ ID NO: 72385 - DNA, 15 bp, Artificial Sequence
  dgRNA
  Olfr555
attgggttagcaaat

SEQ ID NO: 72386 - DNA, 15 bp, Artificial Sequence
  dgRNA
  Olfr555
ttacagctcctaaac

SEQ ID NO: 72387 - DNA, 15 bp, Artificial Sequence
  dgRNA
  Esp4
ctctcataactattg

SEQ ID NO: 72388 - DNA, 15 bp, Artificial Sequence
  dgRNA
  Esp4
ttaatccactctttt

SEQ ID NO: 72389 - DNA, 15 bp, Artificial Sequence
  dgRNA
  Esp4
gtcccttttaaagta

SEQ ID NO: 72390 - DNA, 15 bp, Artificial Sequence
  dgRNA
  Esp4
gttatgagagtgata

SEQ ID NO: 72391 - DNA, 15 bp, Artificial Sequence
  dgRNA
  Cog8
agccgccgcctaccg

SEQ ID NO: 72392 - DNA, 15 bp, Artificial Sequence
  dgRNA
  Cog8
cgccgcctaccgtgg

SEQ ID NO: 72393 - DNA, 15 bp, Artificial Sequence
  dgRNA
  Cog8
accgtggcggacttc

SEQ ID NO: 72394 - DNA, 15 bp, Artificial Sequence
  dgRNA
  Cog8
ccgtggcggacttcc

SEQ ID NO: 72395 - DNA, 15 bp, Artificial Sequence
  dgRNA
  Speg
gagctccagtttgcc

SEQ ID NO: 72396 - DNA, 15 bp, Artificial Sequence
  dgRNA
  Speg
ctgcctcgcctatgt

SEQ ID NO: 72397 - DNA, 15 bp, Artificial Sequence
  dgRNA
  Speg
atgtgggcctttttc

SEQ ID NO: 72398 - DNA, 15 bp, Artificial Sequence
  dgRNA
  Speg
tagaggagccgtgga

SEQ ID NO: 72399 - DNA, 15 bp, Artificial Sequence
  dgRNA
  Cldn34b2
gaactagaactagtc

SEQ ID NO: 72400 - DNA, 15 bp, Artificial Sequence
  dgRNA
  Cldn34b2
aactagaactagtcc

SEQ ID NO: 72401 - DNA, 15 bp, Artificial Sequence
  dgRNA
  Notch2
ggctcggcggtcgag

SEQ ID NO: 72402 - DNA, 15 bp, Artificial Sequence
  dgRNA
  Notch2
gctcggcggtcgagc

SEQ ID NO: 72403 - DNA, 15 bp, Artificial Sequence
  dgRNA
  Notch2
cggcggtcgagcggg

SEQ ID NO: 72404 - DNA, 15 bp, Artificial Sequence
  dgRNA
  Notch2
cgagcgggcggagta

SEQ ID NO: 72405 - DNA, 15 bp, Artificial Sequence
  dgRNA
  Hist1h1t
tccccgtgggtcacc

SEQ ID NO: 72406 - DNA, 15 bp, Artificial Sequence
  dgRNA
  Hist1h1t
aatgcccctcctccg

SEQ ID NO: 72407 - DNA, 15 bp, Artificial Sequence
  dgRNA
  Hist1h1t
atgcccctcctccgg

SEQ ID NO: 72408 - DNA, 15 bp, Artificial Sequence
  dgRNA
  Hist1h1t
cctcctccgggggcg

SEQ ID NO: 72409 - DNA, 15 bp, Artificial Sequence
  dgRNA
  Paics
atcgaacgcctcaag

SEQ ID NO: 72410 - DNA, 15 bp, Artificial Sequence
  dgRNA
  Paics
tgcctccttcccggg

SEQ ID NO: 72411 - DNA, 15 bp, Artificial Sequence
  dgRNA
  Paics
cttcccgggcgggct

SEQ ID NO: 72412 - DNA, 15 bp, Artificial Sequence
  dgRNA
  Paics
aggttctcgctactg

SEQ ID NO: 72413 - DNA, 15 bp, Artificial Sequence
  dgRNA
  Zc3h4
ccgctccctgacgac

SEQ ID NO: 72414 - DNA, 15 bp, Artificial Sequence
  dgRNA
  Zc3h4
ccctgacgacaggtc

SEQ ID NO: 72415 - DNA, 15 bp, Artificial Sequence
  dgRNA
  Zc3h4
acaggtcaggccccc

SEQ ID NO: 72416 - DNA, 15 bp, Artificial Sequence
  dgRNA
  Zc3h4
tcaggccccccggcc

SEQ ID NO: 72417 - DNA, 15 bp, Artificial Sequence
  dgRNA
  Wdr45
cttacttccggagga

SEQ ID NO: 72418 - DNA, 15 bp, Artificial Sequence
  dgRNA
  Wdr45
tcttacttccggagg

SEQ ID NO: 72419 - DNA, 15 bp, Artificial Sequence
  dgRNA
  Wdr45
aggtcttacttccgg

SEQ ID NO: 72420 - DNA, 15 bp, Artificial Sequence
  dgRNA
  Wdr45
atcaggtcttacttc

SEQ ID NO: 72421 - DNA, 15 bp, Artificial Sequence
  dgRNA
  Atp5sl
tctgtttacgttacc

SEQ ID NO: 72422 - DNA, 15 bp, Artificial Sequence
  dgRNA
  Atp5sl
cgttacctggcaaga

SEQ ID NO: 72423 - DNA, 15 bp, Artificial Sequence
  dgRNA
  Atp5sl
tggcggcgcccagag

SEQ ID NO: 72424 - DNA, 15 bp, Artificial Sequence
  dgRNA
  Atp5sl
ggcgcccagagcggt

SEQ ID NO: 72425 - DNA, 15 bp, Artificial Sequence
  dgRNA
  Fam216b
ctttgtcccatatcc

SEQ ID NO: 72426 - DNA, 15 bp, Artificial Sequence
  dgRNA
  Fam216b
tatccaagcaacacc

SEQ ID NO: 72427 - DNA, 15 bp, Artificial Sequence
  dgRNA
  Uts2b
gtgaatcatgttgac

SEQ ID NO: 72428 - DNA, 15 bp, Artificial Sequence
  dgRNA
  Uts2b
aggcattcttaatgc

SEQ ID NO: 72429 - DNA, 15 bp, Artificial Sequence
  dgRNA
  Uts2b
acatgattcactgtc

SEQ ID NO: 72430 - DNA, 15 bp, Artificial Sequence
  dgRNA
  Cpt1c
gtagtacctaaaaga

SEQ ID NO: 72431 - DNA, 15 bp, Artificial Sequence
  dgRNA
  Cpt1c
tacctaaaagagggc

SEQ ID NO: 72432 - DNA, 15 bp, Artificial Sequence
  dgRNA
  Cpt1c
gtttcttgaacaaac

SEQ ID NO: 72433 - DNA, 15 bp, Artificial Sequence
  dgRNA
  Cpt1c
agagggttggacgct

SEQ ID NO: 72434 - DNA, 15 bp, Artificial Sequence
  dgRNA
  Fmo4
tgtcgtttcaaagac

SEQ ID NO: 72435 - DNA, 15 bp, Artificial Sequence
  dgRNA
  Fmo4
gtcgtttcaaagaca

SEQ ID NO: 72436 - DNA, 15 bp, Artificial Sequence
  dgRNA
  Fmo4
agttcttcacggtga

SEQ ID NO: 72437 - DNA, 15 bp, Artificial Sequence
  dgRNA
  Fmo4
ggaaagtacgttagt

SEQ ID NO: 72438 - DNA, 15 bp, Artificial Sequence
  dgRNA
  Aifm3
gtttgctctacttat

SEQ ID NO: 72439 - DNA, 15 bp, Artificial Sequence
  dgRNA
  Aifm3
gactcaaacccgggc

SEQ ID NO: 72440 - DNA, 15 bp, Artificial Sequence
  dgRNA
  Aifm3
tcaaacccgggcagg

SEQ ID NO: 72441 - DNA, 15 bp, Artificial Sequence
  dgRNA
  Aifm3
caaacccgggcaggt

SEQ ID NO: 72442 - DNA, 15 bp, Artificial Sequence
  dgRNA
  Arntl
tatcggtcactcgat

SEQ ID NO: 72443 - DNA, 15 bp, Artificial Sequence
  dgRNA
  Arntl
gagcagaacgcgaat

SEQ ID NO: 72444 - DNA, 15 bp, Artificial Sequence
  dgRNA
  Arntl
gaacgcgaattggtt

SEQ ID NO: 72445 - DNA, 15 bp, Artificial Sequence
  dgRNA
  Arntl
aacgcgaattggttt

SEQ ID NO: 72446 - DNA, 15 bp, Artificial Sequence
  dgRNA
  Msgn1
ggaaagtgacacccg

SEQ ID NO: 72447 - DNA, 15 bp, Artificial Sequence
  dgRNA
  Msgn1
aaccaaggaccgaga

SEQ ID NO: 72448 - DNA, 15 bp, Artificial Sequence
  dgRNA
  Msgn1
gatcggggacaaagt

SEQ ID NO: 72449 - DNA, 15 bp, Artificial Sequence
  dgRNA
  Msgn1
ggatcggggacaaag

SEQ ID NO: 72450 - DNA, 15 bp, Artificial Sequence
  dgRNA
  Lbx1
actgacaggcgcatt

SEQ ID NO: 72451 - DNA, 15 bp, Artificial Sequence
  dgRNA
  Lbx1
acaggcgcattaggc

SEQ ID NO: 72452 - DNA, 15 bp, Artificial Sequence
  dgRNA
  Lbx1
caggctaattccagc

SEQ ID NO: 72453 - DNA, 15 bp, Artificial Sequence
  dgRNA
  Lbx1
cggctcctcctaccc

SEQ ID NO: 72454 - DNA, 15 bp, Artificial Sequence
  dgRNA
  Plcxd2
ctgtgtaccagcccg

SEQ ID NO: 72455 - DNA, 15 bp, Artificial Sequence
  dgRNA
  Plcxd2
gcccggggaaaccca

SEQ ID NO: 72456 - DNA, 15 bp, Artificial Sequence
  dgRNA
  Plcxd2
agagatggtgcaacc

SEQ ID NO: 72457 - DNA, 15 bp, Artificial Sequence
  dgRNA
  Plcxd2
gagatggtgcaaccc

SEQ ID NO: 72458 - DNA, 15 bp, Artificial Sequence
  dgRNA
  Krt82
cccggcattgaccac

SEQ ID NO: 72459 - DNA, 15 bp, Artificial Sequence
  dgRNA
  Krt82
gatttagtagtgatt

SEQ ID NO: 72460 - DNA, 15 bp, Artificial Sequence
  dgRNA
  Krt82
tttagtagtgattag

SEQ ID NO: 72461 - DNA, 15 bp, Artificial Sequence
  dgRNA
  Krt82
cccccgccaaataaa

SEQ ID NO: 72462 - DNA, 15 bp, Artificial Sequence
  dgRNA
  Akr1c19
ggtcaatcattaaac

SEQ ID NO: 72463 - DNA, 15 bp, Artificial Sequence
  dgRNA
  Akr1c19
acaggtaatgtcact

SEQ ID NO: 72464 - DNA, 15 bp, Artificial Sequence
  dgRNA
  Akr1c19
gggtaaccattagac

SEQ ID NO: 72465 - DNA, 15 bp, Artificial Sequence
  dgRNA
  Akr1c19
ctgcttagacattag

SEQ ID NO: 72466 - DNA, 15 bp, Artificial Sequence
  dgRNA
  Krt18
atccactccctgtgt

SEQ ID NO: 72467 - DNA, 15 bp, Artificial Sequence
  dgRNA
  Krt18
ctccctgtgtcggtg

SEQ ID NO: 72468 - DNA, 15 bp, Artificial Sequence
  dgRNA
  Krt18
gtcggtgaggatggc

SEQ ID NO: 72469 - DNA, 15 bp, Artificial Sequence
  dgRNA
  Krt18
gggctgcgacctgtt

SEQ ID NO: 72470 - DNA, 15 bp, Artificial Sequence
  dgRNA
  Uprt
aaccagggatatctc

SEQ ID NO: 72471 - DNA, 15 bp, Artificial Sequence
  dgRNA
  Uprt
gataatctctcaagc

SEQ ID NO: 72472 - DNA, 15 bp, Artificial Sequence
  dgRNA
  Uprt
ataaggtgtctaagc

SEQ ID NO: 72473 - DNA, 15 bp, Artificial Sequence
  dgRNA
  Uprt
agccggcagtgcgtc

SEQ ID NO: 72474 - DNA, 15 bp, Artificial Sequence
  dgRNA
  Tuba1c
ggctagccttctaga

SEQ ID NO: 72475 - DNA, 15 bp, Artificial Sequence
  dgRNA
  Tuba1c
cgggagtaaagagta

SEQ ID NO: 72476 - DNA, 15 bp, Artificial Sequence
  dgRNA
  Tuba1c
gtgcttaggacccat

SEQ ID NO: 72477 - DNA, 15 bp, Artificial Sequence
  dgRNA
  Tuba1c
cttaggacccattgg

SEQ ID NO: 72478 - DNA, 15 bp, Artificial Sequence
  dgRNA
  Rpl10l
aagttccaaattcgg

SEQ ID NO: 72479 - DNA, 15 bp, Artificial Sequence
  dgRNA
  Rpl10l
agttccaaattcggt

SEQ ID NO: 72480 - DNA, 15 bp, Artificial Sequence
  dgRNA
  Rpl10l
aaattcggtgggcag

SEQ ID NO: 72481 - DNA, 15 bp, Artificial Sequence
  dgRNA
  Rpl10l
cactgaggcctgcgc

SEQ ID NO: 72482 - DNA, 15 bp, Artificial Sequence
  dgRNA
  Drg1
accctcggcgcgctc

SEQ ID NO: 72483 - DNA, 15 bp, Artificial Sequence
  dgRNA
  Drg1
ccctcggcgcgctcc

SEQ ID NO: 72484 - DNA, 15 bp, Artificial Sequence
  dgRNA
  Drg1
cgcgctccgggaagt

SEQ ID NO: 72485 - DNA, 15 bp, Artificial Sequence
  dgRNA
  Drg1
cccgagcgaccgctc

SEQ ID NO: 72486 - DNA, 15 bp, Artificial Sequence
  dgRNA
  Map3k14
cccagccttcggcgc

SEQ ID NO: 72487 - DNA, 15 bp, Artificial Sequence
  dgRNA
  Map3k14
cggcgctggataccc

SEQ ID NO: 72488 - DNA, 15 bp, Artificial Sequence
  dgRNA
  Map3k14
gctggataccctggc

SEQ ID NO: 72489 - DNA, 15 bp, Artificial Sequence
  dgRNA
  Map3k14
agccaatcgctgctg

SEQ ID NO: 72490 - DNA, 15 bp, Artificial Sequence
  dgRNA
  Pigu
ctcttgcttgatcag

SEQ ID NO: 72491 - DNA, 15 bp, Artificial Sequence
  dgRNA
  Pigu
ccgtcgactcgccgc

SEQ ID NO: 72492 - DNA, 15 bp, Artificial Sequence
  dgRNA
  Pigu
cgtcgactcgccgca

SEQ ID NO: 72493 - DNA, 15 bp, Artificial Sequence
  dgRNA
  Pigu
cgccgcagggctttc

SEQ ID NO: 72494 - DNA, 15 bp, Artificial Sequence
  dgRNA
  Csrp2bp
agcactgcgacttcc

SEQ ID NO: 72495 - DNA, 15 bp, Artificial Sequence
  dgRNA
  Csrp2bp
gcgacttcctggtga

SEQ ID NO: 72496 - DNA, 15 bp, Artificial Sequence
  dgRNA
  Csrp2bp
aggcggtccccaaat

SEQ ID NO: 72497 - DNA, 15 bp, Artificial Sequence
  dgRNA
  Csrp2bp
caagaagcagcgaag

SEQ ID NO: 72498 - DNA, 15 bp, Artificial Sequence
  dgRNA
  Ccdc187
gctagagccatgagt

SEQ ID NO: 72499 - DNA, 15 bp, Artificial Sequence
  dgRNA
  Ccdc187
acactcagtgacacg

SEQ ID NO: 72500 - DNA, 15 bp, Artificial Sequence
  dgRNA
  Ccdc187
gttattatgctgtca

SEQ ID NO: 72501 - DNA, 15 bp, Artificial Sequence
  dgRNA
  Ccdc187
gccattgtctaccca

SEQ ID NO: 72502 - DNA, 15 bp, Artificial Sequence
  dgRNA
  Gpr155
cggggcctaaaggcg

SEQ ID NO: 72503 - DNA, 15 bp, Artificial Sequence
  dgRNA
  Gpr155
ggcctaaaggcgagg

SEQ ID NO: 72504 - DNA, 15 bp, Artificial Sequence
  dgRNA
  Gpr155
gtggagacccgcatt

SEQ ID NO: 72505 - DNA, 15 bp, Artificial Sequence
  dgRNA
  Gpr155
tggagacccgcattc

SEQ ID NO: 72506 - DNA, 15 bp, Artificial Sequence
  dgRNA
  H2afj
cggctaccctagtgc

SEQ ID NO: 72507 - DNA, 15 bp, Artificial Sequence
  dgRNA
  H2afj
cagttaactacatcc

SEQ ID NO: 72508 - DNA, 15 bp, Artificial Sequence
  dgRNA
  H2afj
tgaactatgtaaatt

SEQ ID NO: 72509 - DNA, 15 bp, Artificial Sequence
  dgRNA
  H2afj
acatctggatgggcg

SEQ ID NO: 72510 - DNA, 15 bp, Artificial Sequence
  dgRNA
  Angptl6
aaggaagagactcgt

SEQ ID NO: 72511 - DNA, 15 bp, Artificial Sequence
  dgRNA
  Angptl6
aggaagagactcgta

SEQ ID NO: 72512 - DNA, 15 bp, Artificial Sequence
  dgRNA
  Angptl6
agactcgtagggcag

SEQ ID NO: 72513 - DNA, 15 bp, Artificial Sequence
  dgRNA
  Angptl6
tctgttatcatgctc

SEQ ID NO: 72514 - DNA, 15 bp, Artificial Sequence
  dgRNA
  Gtse1
catgggaacttccgg

SEQ ID NO: 72515 - DNA, 15 bp, Artificial Sequence
  dgRNA
  Gtse1
gtttcctgcgcccag

SEQ ID NO: 72516 - DNA, 15 bp, Artificial Sequence
  dgRNA
  Gtse1
agcggagccaatccg

SEQ ID NO: 72517 - DNA, 15 bp, Artificial Sequence
  dgRNA
  Gtse1
agccaatccgtggct

SEQ ID NO: 72518 - DNA, 15 bp, Artificial Sequence
  dgRNA
  Serpina16
agccctctcaatgac

SEQ ID NO: 72519 - DNA, 15 bp, Artificial Sequence
  dgRNA
  Serpina16
ggatatttgagggta

SEQ ID NO: 72520 - DNA, 15 bp, Artificial Sequence
  dgRNA
  Serpina16
gatatttgagggtag

SEQ ID NO: 72521 - DNA, 15 bp, Artificial Sequence
  dgRNA
  Serpina16
ggggtgaaaagactt

SEQ ID NO: 72522 - DNA, 15 bp, Artificial Sequence
  dgRNA
  Pla2g4a
gcagaagacttctag

SEQ ID NO: 72523 - DNA, 15 bp, Artificial Sequence
  dgRNA
  Pla2g4a
acttctagtgggttc

SEQ ID NO: 72524 - DNA, 15 bp, Artificial Sequence
  dgRNA
  Pla2g4a
gtggtcaaaatactc

SEQ ID NO: 72525 - DNA, 15 bp, Artificial Sequence
  dgRNA
  Olfr1079
ctaatttgacatatt

SEQ ID NO: 72526 - DNA, 15 bp, Artificial Sequence
  dgRNA
  Olfr1079
tactctactcatgat

SEQ ID NO: 72527 - DNA, 15 bp, Artificial Sequence
  dgRNA
  Tmem119
ctgggaacgttctcc

SEQ ID NO: 72528 - DNA, 15 bp, Artificial Sequence
  dgRNA
  Tmem119
actccctgaaggatg

SEQ ID NO: 72529 - DNA, 15 bp, Artificial Sequence
  dgRNA
  Slfn1
tcaaccaatgaaacc

SEQ ID NO: 72530 - DNA, 15 bp, Artificial Sequence
  dgRNA
  Slfn1
caaccaatgaaaccg

SEQ ID NO: 72531 - DNA, 15 bp, Artificial Sequence
  dgRNA
  Slfn1
aatcgggacctagag

SEQ ID NO: 72532 - DNA, 15 bp, Artificial Sequence
  dgRNA
  Slfn1
cagtgcaatccacta

SEQ ID NO: 72533 - DNA, 15 bp, Artificial Sequence
  dgRNA
  Nop56
ctacagacgcagtac

SEQ ID NO: 72534 - DNA, 15 bp, Artificial Sequence
  dgRNA
  Nop56
cgcagccgcagaggc

SEQ ID NO: 72535 - DNA, 15 bp, Artificial Sequence
  dgRNA
  Nop56
gcccgctcgcgcccg

SEQ ID NO: 72536 - DNA, 15 bp, Artificial Sequence
  dgRNA
  Nop56
gtccaacccgcccga

SEQ ID NO: 72537 - DNA, 15 bp, Artificial Sequence
  dgRNA
  Gpr1
gtaactagaatgcag

SEQ ID NO: 72538 - DNA, 15 bp, Artificial Sequence
  dgRNA
  Gpr1
aactagccccaccag

SEQ ID NO: 72539 - DNA, 15 bp, Artificial Sequence
  dgRNA
  Gpr1
aaaacataacgtttt

SEQ ID NO: 72540 - DNA, 15 bp, Artificial Sequence
  dgRNA
  Eef2kmt
aaacgctccccagtc

SEQ ID NO: 72541 - DNA, 15 bp, Artificial Sequence
  dgRNA
  Eef2kmt
aggcccaacccggcc

SEQ ID NO: 72542 - DNA, 15 bp, Artificial Sequence
  dgRNA
  Eef2kmt
gtactccccgccccg

SEQ ID NO: 72543 - DNA, 15 bp, Artificial Sequence
  dgRNA
  Eef2kmt
tactccccgccccgc

SEQ ID NO: 72544 - DNA, 15 bp, Artificial Sequence
  dgRNA
  Rab10
cgcctgcgcagttcc

SEQ ID NO: 72545 - DNA, 15 bp, Artificial Sequence
  dgRNA
  Rab10
gcctgcgcagttccc

SEQ ID NO: 72546 - DNA, 15 bp, Artificial Sequence
  dgRNA
  Rab10
gccgcacctcccccg

SEQ ID NO: 72547 - DNA, 15 bp, Artificial Sequence
  dgRNA
  Rab10
cgcacctcccccgcg

SEQ ID NO: 72548 - DNA, 15 bp, Artificial Sequence
  dgRNA
  Abtb2
gctacaccccattct

SEQ ID NO: 72549 - DNA, 15 bp, Artificial Sequence
  dgRNA
  Abtb2
atttcccgcccctct

SEQ ID NO: 72550 - DNA, 15 bp, Artificial Sequence
  dgRNA
  Abtb2
cctctcggaaaccat

SEQ ID NO: 72551 - DNA, 15 bp, Artificial Sequence
  dgRNA
  Abtb2
agcccttgcccggcg

SEQ ID NO: 72552 - DNA, 15 bp, Artificial Sequence
  dgRNA
  Gm5134
gtagtctttagcacc

SEQ ID NO: 72553 - DNA, 15 bp, Artificial Sequence
  dgRNA
  Gm5134
tagtctttagcacct

SEQ ID NO: 72554 - DNA, 15 bp, Artificial Sequence
  dgRNA
  Gm5134
ctctcggccgcacag

SEQ ID NO: 72555 - DNA, 15 bp, Artificial Sequence
  dgRNA
  Gm5134
cttgcgaaccagagc

SEQ ID NO: 72556 - DNA, 15 bp, Artificial Sequence
  dgRNA
  Ikzf1
cgcagccaacttagc

SEQ ID NO: 72557 - DNA, 15 bp, Artificial Sequence
  dgRNA
  Ikzf1
gcagccaacttagca

SEQ ID NO: 72558 - DNA, 15 bp, Artificial Sequence
  dgRNA
  Ikzf1
taacaagtgcctgcg

SEQ ID NO: 72559 - DNA, 15 bp, Artificial Sequence
  dgRNA
  Ikzf1
ctgcgcggccgcgcc

SEQ ID NO: 72560 - DNA, 15 bp, Artificial Sequence
  dgRNA
  Dbf4
tgcatacttggagtg

SEQ ID NO: 72561 - DNA, 15 bp, Artificial Sequence
  dgRNA
  Idh2
agccgtgagcccccg

SEQ ID NO: 72562 - DNA, 15 bp, Artificial Sequence
  dgRNA
  Idh2
gcccccgcggcccga

SEQ ID NO: 72563 - DNA, 15 bp, Artificial Sequence
  dgRNA
  Idh2
cccccgcggcccgat

SEQ ID NO: 72564 - DNA, 15 bp, Artificial Sequence
  dgRNA
  Idh2
cccgatgggtctccc

SEQ ID NO: 72565 - DNA, 15 bp, Artificial Sequence
  dgRNA
  Cyth1
aaacgcaaactaaag

SEQ ID NO: 72566 - DNA, 15 bp, Artificial Sequence
  dgRNA
  Cyth1
ctaaagaggtcctca

SEQ ID NO: 72567 - DNA, 15 bp, Artificial Sequence
  dgRNA
  Cyth1
taaagaggtcctcaa

SEQ ID NO: 72568 - DNA, 15 bp, Artificial Sequence
  dgRNA
  Cyth1
aaagaggtcctcaag

SEQ ID NO: 72569 - DNA, 15 bp, Artificial Sequence
  dgRNA
  Twistnb
tgctctataggtaca

SEQ ID NO: 72570 - DNA, 15 bp, Artificial Sequence
  dgRNA
  Twistnb
ggtacacggcctcag

SEQ ID NO: 72571 - DNA, 15 bp, Artificial Sequence
  dgRNA
  Twistnb
cctcagaggtttatc

SEQ ID NO: 72572 - DNA, 15 bp, Artificial Sequence
  dgRNA
  Twistnb
ggtttatctggactc

SEQ ID NO: 72573 - DNA, 15 bp, Artificial Sequence
  dgRNA
  Cln8
tgataaagggctcta

SEQ ID NO: 72574 - DNA, 15 bp, Artificial Sequence
  dgRNA
  Cln8
taaagggctctaggg

SEQ ID NO: 72575 - DNA, 15 bp, Artificial Sequence
  dgRNA
  Cln8
gaggactctgttatg

SEQ ID NO: 72576 - DNA, 15 bp, Artificial Sequence
  dgRNA
  Cln8
ctgcaatccagggta

SEQ ID NO: 72577 - DNA, 15 bp, Artificial Sequence
  dgRNA
  Gpr174
acaaggctattcaac

SEQ ID NO: 72578 - DNA, 15 bp, Artificial Sequence
  dgRNA
  Gpr174
ctcattaatgataca

SEQ ID NO: 72579 - DNA, 15 bp, Artificial Sequence
  dgRNA
  Ifit3
tataagggggcagtg

SEQ ID NO: 72580 - DNA, 15 bp, Artificial Sequence
  dgRNA
  Ifit3
atataagggggcagt

SEQ ID NO: 72581 - DNA, 15 bp, Artificial Sequence
  dgRNA
  Ifit3
gaggattatataagg

SEQ ID NO: 72582 - DNA, 15 bp, Artificial Sequence
  dgRNA
  Ifit3
tcagaggattatata

SEQ ID NO: 72583 - DNA, 15 bp, Artificial Sequence
  dgRNA
  Rhou
agcgcggcgcgcaga

SEQ ID NO: 72584 - DNA, 15 bp, Artificial Sequence
  dgRNA
  Rhou
gcgcggcgcgcagac

SEQ ID NO: 72585 - DNA, 15 bp, Artificial Sequence
  dgRNA
  Rhou
cgcggcgcgcagacg

SEQ ID NO: 72586 - DNA, 15 bp, Artificial Sequence
  dgRNA
  Rhou
gcggcgcgcagacgg

SEQ ID NO: 72587 - DNA, 15 bp, Artificial Sequence
  dgRNA
  Zfp790
cacagaccggaatgt

SEQ ID NO: 72588 - DNA, 15 bp, Artificial Sequence
  dgRNA
  Zfp790
ctacattccggtctg

SEQ ID NO: 72589 - DNA, 15 bp, Artificial Sequence
  dgRNA
  Irf5
ggcgcggactaggtg

SEQ ID NO: 72590 - DNA, 15 bp, Artificial Sequence
  dgRNA
  Irf5
aggctacagggtatc

SEQ ID NO: 72591 - DNA, 15 bp, Artificial Sequence
  dgRNA
  Irf5
ggctacagggtatct

SEQ ID NO: 72592 - DNA, 15 bp, Artificial Sequence
  dgRNA
  Irf5
gcgcccgcctggagc

SEQ ID NO: 72593 - DNA, 15 bp, Artificial Sequence
  dgRNA
  6430573F11Rik
tcgtcttttgttaag

SEQ ID NO: 72594 - DNA, 15 bp, Artificial Sequence
  dgRNA
  6430573F11Rik
gagactcatactgag

SEQ ID NO: 72595 - DNA, 15 bp, Artificial Sequence
  dgRNA
  6430573F11Rik
cggtagaacctgtga

SEQ ID NO: 72596 - DNA, 15 bp, Artificial Sequence
  dgRNA
  6430573F11Rik
ggtagaacctgtgaa

SEQ ID NO: 72597 - DNA, 15 bp, Artificial Sequence
  dgRNA
  Lce1l
cgggcctagcataaa

SEQ ID NO: 72598 - DNA, 15 bp, Artificial Sequence
  dgRNA
  Lce1l
tgggaatagttcaag

SEQ ID NO: 72599 - DNA, 15 bp, Artificial Sequence
  dgRNA
  Lce1l
ctctcggatctctct

SEQ ID NO: 72600 - DNA, 15 bp, Artificial Sequence
  dgRNA
  Lce1l
actctcggatctctc

SEQ ID NO: 72601 - DNA, 15 bp, Artificial Sequence
  dgRNA
  Ces1f
ctgtattgtgtaatt

SEQ ID NO: 72602 - DNA, 15 bp, Artificial Sequence
  dgRNA
  Gmppb
gactcgcgagttctc

SEQ ID NO: 72603 - DNA, 15 bp, Artificial Sequence
  dgRNA
  Gmppb
actcgcgagttctcc

SEQ ID NO: 72604 - DNA, 15 bp, Artificial Sequence
  dgRNA
  Gmppb
ttctccgggtcccca

SEQ ID NO: 72605 - DNA, 15 bp, Artificial Sequence
  dgRNA
  Gmppb
cgttggaaatctaat

SEQ ID NO: 72606 - DNA, 15 bp, Artificial Sequence
  dgRNA
  Lgals3bp
ccactctccttcgcc

SEQ ID NO: 72607 - DNA, 15 bp, Artificial Sequence
  dgRNA
  Lgals3bp
caggcatcctggcga

SEQ ID NO: 72608 - DNA, 15 bp, Artificial Sequence
  dgRNA
  Lgals3bp
aatacatctccaggc

SEQ ID NO: 72609 - DNA, 15 bp, Artificial Sequence
  dgRNA
  Rreb1
ggtcctagctgttga

SEQ ID NO: 72610 - DNA, 15 bp, Artificial Sequence
  dgRNA
  Rreb1
atggacactgagtag

SEQ ID NO: 72611 - DNA, 15 bp, Artificial Sequence
  dgRNA
  Rreb1
gtgccttcaacagct

SEQ ID NO: 72612 - DNA, 15 bp, Artificial Sequence
  dgRNA
  Gng11
gtagtgttcctttcc

SEQ ID NO: 72613 - DNA, 15 bp, Artificial Sequence
  dgRNA
  Gng11
acccggatgttaagt

SEQ ID NO: 72614 - DNA, 15 bp, Artificial Sequence
  dgRNA
  Gng11
gtccaacttaacatc

SEQ ID NO: 72615 - DNA, 15 bp, Artificial Sequence
  dgRNA
  Fndc9
aaagcctactcagac

SEQ ID NO: 72616 - DNA, 15 bp, Artificial Sequence
  dgRNA
  Fndc9
tgcgtagatgcctgc

SEQ ID NO: 72617 - DNA, 15 bp, Artificial Sequence
  dgRNA
  Fndc9
gaataatgtgagcgt

SEQ ID NO: 72618 - DNA, 15 bp, Artificial Sequence
  dgRNA
  Fndc9
ataatgtgagcgttg

SEQ ID NO: 72619 - DNA, 15 bp, Artificial Sequence
  dgRNA
  Nfia
cgagcgcggagcgag

SEQ ID NO: 72620 - DNA, 15 bp, Artificial Sequence
  dgRNA
  Nfia
gcgcggagcgagcgg

SEQ ID NO: 72621 - DNA, 15 bp, Artificial Sequence
  dgRNA
  Nfia
cgcggagcgagcggc

SEQ ID NO: 72622 - DNA, 15 bp, Artificial Sequence
  dgRNA
  Nfia
ggcgggcggccctgc

SEQ ID NO: 72623 - DNA, 15 bp, Artificial Sequence
  dgRNA
  Mnd1
tctcaagccccgccc

SEQ ID NO: 72624 - DNA, 15 bp, Artificial Sequence
  dgRNA
  Mnd1
gttggggcctggcgt

SEQ ID NO: 72625 - DNA, 15 bp, Artificial Sequence
  dgRNA
  Mnd1
agttggggcctggcg

SEQ ID NO: 72626 - DNA, 15 bp, Artificial Sequence
  dgRNA
  Mnd1
cggactgagaccaga

SEQ ID NO: 72627 - DNA, 15 bp, Artificial Sequence
  dgRNA
  Calhm1
tttgctagtccagcc

SEQ ID NO: 72628 - DNA, 15 bp, Artificial Sequence
  dgRNA
  Calhm1
gacagcccagtcatg

SEQ ID NO: 72629 - DNA, 15 bp, Artificial Sequence
  dgRNA
  Calhm1
ggatgcctagtgggc

SEQ ID NO: 72630 - DNA, 15 bp, Artificial Sequence
  dgRNA
  Calhm1
ggcagggtgacctac

SEQ ID NO: 72631 - DNA, 15 bp, Artificial Sequence
  dgRNA
  Zfp704
gattttcagagagcg

SEQ ID NO: 72632 - DNA, 15 bp, Artificial Sequence
  dgRNA
  Zfp704
attttcagagagcgc

SEQ ID NO: 72633 - DNA, 15 bp, Artificial Sequence
  dgRNA
  Zfp704
cagagagcgcgggtc

SEQ ID NO: 72634 - DNA, 15 bp, Artificial Sequence
  dgRNA
  Zfp704
agagagcgcgggtct

SEQ ID NO: 72635 - DNA, 15 bp, Artificial Sequence
  dgRNA
  Galntl5
aagcctgcataccct

SEQ ID NO: 72636 - DNA, 15 bp, Artificial Sequence
  dgRNA
  Galntl5
gacagtagttatgat

SEQ ID NO: 72637 - DNA, 15 bp, Artificial Sequence
  dgRNA
  Galntl5
tatgataggcccctt

SEQ ID NO: 72638 - DNA, 15 bp, Artificial Sequence
  dgRNA
  Galntl5
actgttggcccacag

SEQ ID NO: 72639 - DNA, 15 bp, Artificial Sequence
  dgRNA
  Cd200
tactgccatttggca

SEQ ID NO: 72640 - DNA, 15 bp, Artificial Sequence
  dgRNA
  Cd200
aggcgagaacctggc

SEQ ID NO: 72641 - DNA, 15 bp, Artificial Sequence
  dgRNA
  Cd200
ggcgagaacctggcg

SEQ ID NO: 72642 - DNA, 15 bp, Artificial Sequence
  dgRNA
  Cd200
gcgagaacctggcgg

SEQ ID NO: 72643 - DNA, 15 bp, Artificial Sequence
  dgRNA
  Havcr2
gtcattacacagaac

SEQ ID NO: 72644 - DNA, 15 bp, Artificial Sequence
  dgRNA
  Havcr2
ttaacagtactaacg

SEQ ID NO: 72645 - DNA, 15 bp, Artificial Sequence
  dgRNA
  Havcr2
taacgtggtaatcac

SEQ ID NO: 72646 - DNA, 15 bp, Artificial Sequence
  dgRNA
  Havcr2
tagcactcgtgattc

SEQ ID NO: 72647 - DNA, 15 bp, Artificial Sequence
  dgRNA
  Rrp8
cagcggacgacccct

SEQ ID NO: 72648 - DNA, 15 bp, Artificial Sequence
  dgRNA
  Rrp8
cgaccccttggctcg

SEQ ID NO: 72649 - DNA, 15 bp, Artificial Sequence
  dgRNA
  Rrp8
cttggctcgaggagc

SEQ ID NO: 72650 - DNA, 15 bp, Artificial Sequence
  dgRNA
  Rrp8
gctagtttcccgagt

SEQ ID NO: 72651 - DNA, 15 bp, Artificial Sequence
  dgRNA
  Med6
tccccgctaaccgta

SEQ ID NO: 72652 - DNA, 15 bp, Artificial Sequence
  dgRNA
  Med6
cgctaaccgtacggc

SEQ ID NO: 72653 - DNA, 15 bp, Artificial Sequence
  dgRNA
  Med6
cctccgcttccgtcg

SEQ ID NO: 72654 - DNA, 15 bp, Artificial Sequence
  dgRNA
  Med6
gcctttactgtgcgc

SEQ ID NO: 72655 - DNA, 15 bp, Artificial Sequence
  dgRNA
  Ccdc84
ctgccgggttttctg

SEQ ID NO: 72656 - DNA, 15 bp, Artificial Sequence
  dgRNA
  Ccdc84
tgccgggttttctgc

SEQ ID NO: 72657 - DNA, 15 bp, Artificial Sequence
  dgRNA
  Ccdc84
ttttctgcgggtgcg

SEQ ID NO: 72658 - DNA, 15 bp, Artificial Sequence
  dgRNA
  Ccdc84
tttctgcgggtgcgt

SEQ ID NO: 72659 - DNA, 15 bp, Artificial Sequence
  dgRNA
  Plppr1
ggagcacctaggtag

SEQ ID NO: 72660 - DNA, 15 bp, Artificial Sequence
  dgRNA
  Plppr1
gagcacctaggtagc

SEQ ID NO: 72661 - DNA, 15 bp, Artificial Sequence
  dgRNA
  Plppr1
aggtagcgggattcc

SEQ ID NO: 72662 - DNA, 15 bp, Artificial Sequence
  dgRNA
  Plppr1
ggtagcgggattccc

SEQ ID NO: 72663 - DNA, 15 bp, Artificial Sequence
  dgRNA
  Ankrd44
ggccccctccccttt

SEQ ID NO: 72664 - DNA, 15 bp, Artificial Sequence
  dgRNA
  Ankrd44
ggctcctggcggagc

SEQ ID NO: 72665 - DNA, 15 bp, Artificial Sequence
  dgRNA
  Ankrd44
gctcctggcggagcg

SEQ ID NO: 72666 - DNA, 15 bp, Artificial Sequence
  dgRNA
  Ankrd44
gtgtgggagggcgcc

SEQ ID NO: 72667 - DNA, 15 bp, Artificial Sequence
  dgRNA
  Tfdp2
gaagcggcgccgccg

SEQ ID NO: 72668 - DNA, 15 bp, Artificial Sequence
  dgRNA
  Tfdp2
gcggccgtgtcgctg

SEQ ID NO: 72669 - DNA, 15 bp, Artificial Sequence
  dgRNA
  Tfdp2
cggccgtgtcgctga

SEQ ID NO: 72670 - DNA, 15 bp, Artificial Sequence
  dgRNA
  Tfdp2
ccgtgtcgctgaggg

SEQ ID NO: 72671 - DNA, 15 bp, Artificial Sequence
  dgRNA
  Kdm2b
aaaacagcgatgcca

SEQ ID NO: 72672 - DNA, 15 bp, Artificial Sequence
  dgRNA
  Kdm2b
ggcgctaacagcgcc

SEQ ID NO: 72673 - DNA, 15 bp, Artificial Sequence
  dgRNA
  Kdm2b
cgcccggtgcgtccc

SEQ ID NO: 72674 - DNA, 15 bp, Artificial Sequence
  dgRNA
  Kdm2b
gccccacacctccta

SEQ ID NO: 72675 - DNA, 15 bp, Artificial Sequence
  dgRNA
  Slc16a10
aggtagctaatttgg

SEQ ID NO: 72676 - DNA, 15 bp, Artificial Sequence
  dgRNA
  Slc16a10
tcaagcgcgcgcgcg

SEQ ID NO: 72677 - DNA, 15 bp, Artificial Sequence
  dgRNA
  Slc16a10
caagcgcgcgcgcgc

SEQ ID NO: 72678 - DNA, 15 bp, Artificial Sequence
  dgRNA
  Slc16a10
cgcgcgggcggtcat

SEQ ID NO: 72679 - DNA, 15 bp, Artificial Sequence
  dgRNA
  Fance
ttcgggagctttgcg

SEQ ID NO: 72680 - DNA, 15 bp, Artificial Sequence
  dgRNA
  Fance
ggagctttgcgcggc

SEQ ID NO: 72681 - DNA, 15 bp, Artificial Sequence
  dgRNA
  Fance
tttgcgcggctggag

SEQ ID NO: 72682 - DNA, 15 bp, Artificial Sequence
  dgRNA
  Fance
aagctcccgaagcca

SEQ ID NO: 72683 - DNA, 15 bp, Artificial Sequence
  dgRNA
  Edem3
cacgtcccgcttctc

SEQ ID NO: 72684 - DNA, 15 bp, Artificial Sequence
  dgRNA
  Edem3
acgtcccgcttctct

SEQ ID NO: 72685 - DNA, 15 bp, Artificial Sequence
  dgRNA
  Edem3
acaaaaggcgggact

SEQ ID NO: 72686 - DNA, 15 bp, Artificial Sequence
  dgRNA
  Edem3
acgtggacaaaaggc

SEQ ID NO: 72687 - DNA, 15 bp, Artificial Sequence
  dgRNA
  Rad18
cgtgcggcgcgctcg

SEQ ID NO: 72688 - DNA, 15 bp, Artificial Sequence
  dgRNA
  Nxf1
tcagtgctaacgcag

SEQ ID NO: 72689 - DNA, 15 bp, Artificial Sequence
  dgRNA
  Nxf1
cagtgctaacgcaga

SEQ ID NO: 72690 - DNA, 15 bp, Artificial Sequence
  dgRNA
  Nxf1
cagagggtttagctc

SEQ ID NO: 72691 - DNA, 15 bp, Artificial Sequence
  dgRNA
  Nxf1
agagggtttagctcc

SEQ ID NO: 72692 - DNA, 15 bp, Artificial Sequence
  dgRNA
  Tfec
attatggggcaataa

SEQ ID NO: 72693 - DNA, 15 bp, Artificial Sequence
  dgRNA
  Tfec
aacggcatcaatgag

SEQ ID NO: 72694 - DNA, 15 bp, Artificial Sequence
  dgRNA
  Papss2
acctccgtagatcat

SEQ ID NO: 72695 - DNA, 15 bp, Artificial Sequence
  dgRNA
  Papss2
tcattggttgataga

SEQ ID NO: 72696 - DNA, 15 bp, Artificial Sequence
  dgRNA
  Papss2
cattggttgatagag

SEQ ID NO: 72697 - DNA, 15 bp, Artificial Sequence
  dgRNA
  Papss2
ctgaattcagggttc

SEQ ID NO: 72698 - DNA, 15 bp, Artificial Sequence
  dgRNA
  Scd4
gagatgaaaccgagg

SEQ ID NO: 72699 - DNA, 15 bp, Artificial Sequence
  dgRNA
  Scd4
atgactggaggaatc

SEQ ID NO: 72700 - DNA, 15 bp, Artificial Sequence
  dgRNA
  Scd4
tcggtttcatctctg

SEQ ID NO: 72701 - DNA, 15 bp, Artificial Sequence
  dgRNA
  Scd4
aatctgctatctcgc

SEQ ID NO: 72702 - DNA, 15 bp, Artificial Sequence
  dgRNA
  Ces2c
tcacccgtcacacaa

SEQ ID NO: 72703 - DNA, 15 bp, Artificial Sequence
  dgRNA
  Ces2c
ccacctacacccttt

SEQ ID NO: 72704 - DNA, 15 bp, Artificial Sequence
  dgRNA
  Ces2c
atagctgcctgtgca

SEQ ID NO: 72705 - DNA, 15 bp, Artificial Sequence
  dgRNA
  Ces2c
cttgtctgggatacc

SEQ ID NO: 72706 - DNA, 15 bp, Artificial Sequence
  dgRNA
  Zfp791
cccagcttaagccct

SEQ ID NO: 72707 - DNA, 15 bp, Artificial Sequence
  dgRNA
  Zfp791
aagccctcggctacc

SEQ ID NO: 72708 - DNA, 15 bp, Artificial Sequence
  dgRNA
  Zfp791
gctacctggtcaatc

SEQ ID NO: 72709 - DNA, 15 bp, Artificial Sequence
  dgRNA
  Zfp791
aaggtgactccctta

SEQ ID NO: 72710 - DNA, 15 bp, Artificial Sequence
  dgRNA
  Tspyl5
gtcttatgaacccct

SEQ ID NO: 72711 - DNA, 15 bp, Artificial Sequence
  dgRNA
  Tspyl5
tcttatgaacccctg

SEQ ID NO: 72712 - DNA, 15 bp, Artificial Sequence
  dgRNA
  Tspyl5
cttgctatcaatgat

SEQ ID NO: 72713 - DNA, 15 bp, Artificial Sequence
  dgRNA
  Tspyl5
tcagcaacactacca

SEQ ID NO: 72714 - DNA, 15 bp, Artificial Sequence
  dgRNA
  Gm4922
actagattgtgagct

SEQ ID NO: 72715 - DNA, 15 bp, Artificial Sequence
  dgRNA
  Gm4922
ttgtgagctcggtct

SEQ ID NO: 72716 - DNA, 15 bp, Artificial Sequence
  dgRNA
  Gm4922
agctcggtcttggtt

SEQ ID NO: 72717 - DNA, 15 bp, Artificial Sequence
  dgRNA
  Gm4922
gctcggtcttggttt

SEQ ID NO: 72718 - DNA, 15 bp, Artificial Sequence
  dgRNA
  Hexdc
taagttctctccacc

SEQ ID NO: 72719 - DNA, 15 bp, Artificial Sequence
  dgRNA
  Dennd3
cttcccaccccgaag

SEQ ID NO: 72720 - DNA, 15 bp, Artificial Sequence
  dgRNA
  Dennd3
acacccacgcaggtc

SEQ ID NO: 72721 - DNA, 15 bp, Artificial Sequence
  dgRNA
  Dennd3
tcgttcacgctatcc

SEQ ID NO: 72722 - DNA, 15 bp, Artificial Sequence
  dgRNA
  Dennd3
aggtcccgtccacac

SEQ ID NO: 72723 - DNA, 15 bp, Artificial Sequence
  dgRNA
  Asprv1
acctgtatcctcatc

SEQ ID NO: 72724 - DNA, 15 bp, Artificial Sequence
  dgRNA
  Asprv1
catctgggctattct

SEQ ID NO: 72725 - DNA, 15 bp, Artificial Sequence
  dgRNA
  Asprv1
atctgggctattcta

SEQ ID NO: 72726 - DNA, 15 bp, Artificial Sequence
  dgRNA
  Asprv1
gctattctagggcat

SEQ ID NO: 72727 - DNA, 15 bp, Artificial Sequence
  dgRNA
  Gjd4
acagaaaacgttcat

SEQ ID NO: 72728 - DNA, 15 bp, Artificial Sequence
  dgRNA
  Gjd4
tattatgtcccgaag

SEQ ID NO: 72729 - DNA, 15 bp, Artificial Sequence
  dgRNA
  Gjd4
atgtcccgaagtggc

SEQ ID NO: 72730 - DNA, 15 bp, Artificial Sequence
  dgRNA
  Gjd4
ctggaatgtcctgcg

SEQ ID NO: 72731 - DNA, 15 bp, Artificial Sequence
  dgRNA
  Cntln
gtggagttttcaagc

SEQ ID NO: 72732 - DNA, 15 bp, Artificial Sequence
  dgRNA
  Cntln
ggaacttgacccgtt

SEQ ID NO: 72733 - DNA, 15 bp, Artificial Sequence
  dgRNA
  Cntln
acccgttaggcgccg

SEQ ID NO: 72734 - DNA, 15 bp, Artificial Sequence
  dgRNA
  Cntln
ggccgcggcgcctaa

SEQ ID NO: 72735 - DNA, 15 bp, Artificial Sequence
  dgRNA
  Ndst2
gctttacagattgta

SEQ ID NO: 72736 - DNA, 15 bp, Artificial Sequence
  dgRNA
  Ndst2
taagggccaagcttg

SEQ ID NO: 72737 - DNA, 15 bp, Artificial Sequence
  dgRNA
  Ndst2
ctaagaacctccacc

SEQ ID NO: 72738 - DNA, 15 bp, Artificial Sequence
  dgRNA
  Ndst2
taagaacctccacca

SEQ ID NO: 72739 - DNA, 15 bp, Artificial Sequence
  dgRNA
  Dna2
ctgaaaagcccgaga

SEQ ID NO: 72740 - DNA, 15 bp, Artificial Sequence
  dgRNA
  Dna2
tgaaaagcccgagac

SEQ ID NO: 72741 - DNA, 15 bp, Artificial Sequence
  dgRNA
  Dna2
gaaaagcccgagacg

SEQ ID NO: 72742 - DNA, 15 bp, Artificial Sequence
  dgRNA
  Dna2
aaaagcccgagacgg

SEQ ID NO: 72743 - DNA, 15 bp, Artificial Sequence
  dgRNA
  Unc5c
agagcagcgcccgct

SEQ ID NO: 72744 - DNA, 15 bp, Artificial Sequence
  dgRNA
  Unc5c
cagcgcccgctcggc

SEQ ID NO: 72745 - DNA, 15 bp, Artificial Sequence
  dgRNA
  Unc5c
cgcccgctcggctgg

SEQ ID NO: 72746 - DNA, 15 bp, Artificial Sequence
  dgRNA
  Unc5c
ccgctcggctggcgg

SEQ ID NO: 72747 - DNA, 15 bp, Artificial Sequence
  dgRNA
  Cdkl5
ggactcgagaacgag

SEQ ID NO: 72748 - DNA, 15 bp, Artificial Sequence
  dgRNA
  Cdkl5
gagaacgagcggcgt

SEQ ID NO: 72749 - DNA, 15 bp, Artificial Sequence
  dgRNA
  Cdkl5
aacgagcggcgtggg

SEQ ID NO: 72750 - DNA, 15 bp, Artificial Sequence
  dgRNA
  Cdkl5
acgagcggcgtgggc

SEQ ID NO: 72751 - DNA, 15 bp, Artificial Sequence
  dgRNA
  Grpel1
cgagcaccagtcact

SEQ ID NO: 72752 - DNA, 15 bp, Artificial Sequence
  dgRNA
  Grpel1
cttggcacgagttcc

SEQ ID NO: 72753 - DNA, 15 bp, Artificial Sequence
  dgRNA
  Grpel1
ttggcacgagttccc

SEQ ID NO: 72754 - DNA, 15 bp, Artificial Sequence
  dgRNA
  Grpel1
gctaccttctgcggg

SEQ ID NO: 72755 - DNA, 15 bp, Artificial Sequence
  dgRNA
  Fbxl4
agggctatctttggc

SEQ ID NO: 72756 - DNA, 15 bp, Artificial Sequence
  dgRNA
  Fbxl4
ggatgagtagcgtaa

SEQ ID NO: 72757 - DNA, 15 bp, Artificial Sequence
  dgRNA
  Fbxl4
agtccccgagcaaac

SEQ ID NO: 72758 - DNA, 15 bp, Artificial Sequence
  dgRNA
  Fbxl4
tcggggactggcagc

SEQ ID NO: 72759 - DNA, 15 bp, Artificial Sequence
  dgRNA
  Cd63
ctgaggtccggctcc

SEQ ID NO: 72760 - DNA, 15 bp, Artificial Sequence
  dgRNA
  Cd63
tggctcgagccttcc

SEQ ID NO: 72761 - DNA, 15 bp, Artificial Sequence
  dgRNA
  Cd63
caggcagcggccacg

SEQ ID NO: 72762 - DNA, 15 bp, Artificial Sequence
  dgRNA
  Cd63
cacgtggccttgtcc

SEQ ID NO: 72763 - DNA, 15 bp, Artificial Sequence
  dgRNA
  Pkhd1l1
atcccagacacaccg

SEQ ID NO: 72764 - DNA, 15 bp, Artificial Sequence
  dgRNA
  Pkhd1l1
acaccgcggacgagc

SEQ ID NO: 72765 - DNA, 15 bp, Artificial Sequence
  dgRNA
  Pkhd1l1
caccgcggacgagct

SEQ ID NO: 72766 - DNA, 15 bp, Artificial Sequence
  dgRNA
  Pkhd1l1
accgcggacgagctg

SEQ ID NO: 72767 - DNA, 15 bp, Artificial Sequence
  dgRNA
  Gpat2
gcgagttgtgggtga

SEQ ID NO: 72768 - DNA, 15 bp, Artificial Sequence
  dgRNA
  Gpat2
cgagttgtgggtgat

SEQ ID NO: 72769 - DNA, 15 bp, Artificial Sequence
  dgRNA
  Gpat2
ggagcagtgatcatg

SEQ ID NO: 72770 - DNA, 15 bp, Artificial Sequence
  dgRNA
  Gpat2
tccagcagagcatat

SEQ ID NO: 72771 - DNA, 15 bp, Artificial Sequence
  dgRNA
  Olfr1253
tagctaaccaacagt

SEQ ID NO: 72772 - DNA, 15 bp, Artificial Sequence
  dgRNA
  Olfr1253
tcatgacctgttaac

SEQ ID NO: 72773 - DNA, 15 bp, Artificial Sequence
  dgRNA
  Igf2
gcaacccccgtgccc

SEQ ID NO: 72774 - DNA, 15 bp, Artificial Sequence
  dgRNA
  Igf2
caacccccgtgccca

SEQ ID NO: 72775 - DNA, 15 bp, Artificial Sequence
  dgRNA
  Igf2
cccgcattccccgcg

SEQ ID NO: 72776 - DNA, 15 bp, Artificial Sequence
  dgRNA
  Igf2
gcgtggctcgagttg

SEQ ID NO: 72777 - DNA, 15 bp, Artificial Sequence
  dgRNA
  Igsf9b
atgcgcatgattctg

SEQ ID NO: 72778 - DNA, 15 bp, Artificial Sequence
  dgRNA
  Igsf9b
caacgcaccttgaaa

SEQ ID NO: 72779 - DNA, 15 bp, Artificial Sequence
  dgRNA
  Igsf9b
aacgcaccttgaaat

SEQ ID NO: 72780 - DNA, 15 bp, Artificial Sequence
  dgRNA
  Igsf9b
ttcttcgcgcagcga

SEQ ID NO: 72781 - DNA, 15 bp, Artificial Sequence
  dgRNA
  Mtm1
cctagtgatgtttcc

SEQ ID NO: 72782 - DNA, 15 bp, Artificial Sequence
  dgRNA
  Irg1
ggaatcatcagatta

SEQ ID NO: 72783 - DNA, 15 bp, Artificial Sequence
  dgRNA
  Irg1
agccctacatctata

SEQ ID NO: 72784 - DNA, 15 bp, Artificial Sequence
  dgRNA
  Irg1
gccctacatctataa

SEQ ID NO: 72785 - DNA, 15 bp, Artificial Sequence
  dgRNA
  Irg1
tcccttatagatgta

SEQ ID NO: 72786 - DNA, 15 bp, Artificial Sequence
  dgRNA
  Zc3hc1
cgtcactattttgat

SEQ ID NO: 72787 - DNA, 15 bp, Artificial Sequence
  dgRNA
  Zc3hc1
ttttgataggtcaga

SEQ ID NO: 72788 - DNA, 15 bp, Artificial Sequence
  dgRNA
  Zc3hc1
cgcgtgtttaggctc

SEQ ID NO: 72789 - DNA, 15 bp, Artificial Sequence
  dgRNA
  Clpb
gtgttaatacaaata

SEQ ID NO: 72790 - DNA, 15 bp, Artificial Sequence
  dgRNA
  Clpb
gttaatacaaatacg

SEQ ID NO: 72791 - DNA, 15 bp, Artificial Sequence
  dgRNA
  Clpb
acaaatacggggctc

SEQ ID NO: 72792 - DNA, 15 bp, Artificial Sequence
  dgRNA
  Clpb
cagctccgctgtcag

SEQ ID NO: 72793 - DNA, 15 bp, Artificial Sequence
  dgRNA
  Adam26a
agagcgcagcgtata

SEQ ID NO: 72794 - DNA, 15 bp, Artificial Sequence
  dgRNA
  Adam26a
gcgctctggtgtctc

SEQ ID NO: 72795 - DNA, 15 bp, Artificial Sequence
  dgRNA
  Adam26a
ttatacgctgcgctc

SEQ ID NO: 72796 - DNA, 15 bp, Artificial Sequence
  dgRNA
  Marveld3
ccccgtccttgagct

SEQ ID NO: 72797 - DNA, 15 bp, Artificial Sequence
  dgRNA
  Marveld3
agctcaaggacgggg

SEQ ID NO: 72798 - DNA, 15 bp, Artificial Sequence
  dgRNA
  Dbndd2
ggcgctgcaggtagg

SEQ ID NO: 72799 - DNA, 15 bp, Artificial Sequence
  dgRNA
  Dbndd2
gcgctgcaggtaggg

SEQ ID NO: 72800 - DNA, 15 bp, Artificial Sequence
  dgRNA
  Dbndd2
tgcggggttgggctc

SEQ ID NO: 72801 - DNA, 15 bp, Artificial Sequence
  dgRNA
  Dbndd2
tcaggtgcggcgaac

SEQ ID NO: 72802 - DNA, 15 bp, Artificial Sequence
  dgRNA
  Ankrd33b
ctgctcgggacaaag

SEQ ID NO: 72803 - DNA, 15 bp, Artificial Sequence
  dgRNA
  Ankrd33b
gacaaagtggccgtg

SEQ ID NO: 72804 - DNA, 15 bp, Artificial Sequence
  dgRNA
  Ankrd33b
aaagtggccgtgtgg

SEQ ID NO: 72805 - DNA, 15 bp, Artificial Sequence
  dgRNA
  Ankrd33b
tcccgggactctaac

SEQ ID NO: 72806 - DNA, 15 bp, Artificial Sequence
  dgRNA
  Cysrt1
gatgtaagtcatggc

SEQ ID NO: 72807 - DNA, 15 bp, Artificial Sequence
  dgRNA
  Cysrt1
ggccatgacccaagg

SEQ ID NO: 72808 - DNA, 15 bp, Artificial Sequence
  dgRNA
  Cysrt1
tgacccaaggaggta

SEQ ID NO: 72809 - DNA, 15 bp, Artificial Sequence
  dgRNA
  Cysrt1
tggcctccacccatc

SEQ ID NO: 72810 - DNA, 15 bp, Artificial Sequence
  dgRNA
  Nmbr
cccgctctctaatag

SEQ ID NO: 72811 - DNA, 15 bp, Artificial Sequence
  dgRNA
  Nmbr
taaatcgcaaaccag

SEQ ID NO: 72812 - DNA, 15 bp, Artificial Sequence
  dgRNA
  Nmbr
aaccagcggcagtga

SEQ ID NO: 72813 - DNA, 15 bp, Artificial Sequence
  dgRNA
  Nmbr
accagcggcagtgaa

SEQ ID NO: 72814 - DNA, 15 bp, Artificial Sequence
  dgRNA
  Commd7
ctgtcacgagaaccg

SEQ ID NO: 72815 - DNA, 15 bp, Artificial Sequence
  dgRNA
  Commd7
cacgagaaccgcggc

SEQ ID NO: 72816 - DNA, 15 bp, Artificial Sequence
  dgRNA
  Commd7
acgagaaccgcggct

SEQ ID NO: 72817 - DNA, 15 bp, Artificial Sequence
  dgRNA
  Commd7
ccgcggctgggagtg

SEQ ID NO: 72818 - DNA, 15 bp, Artificial Sequence
  dgRNA
  Dnajc12
atcgcaaactcccat

SEQ ID NO: 72819 - DNA, 15 bp, Artificial Sequence
  dgRNA
  Dnajc12
catcggaacgttcat

SEQ ID NO: 72820 - DNA, 15 bp, Artificial Sequence
  dgRNA
  Dnajc12
ttggtgtccagatcc

SEQ ID NO: 72821 - DNA, 15 bp, Artificial Sequence
  dgRNA
  Dnajc12
gtccagatcccggga

SEQ ID NO: 72822 - DNA, 15 bp, Artificial Sequence
  dgRNA
  Txnl4a
gcgcgagattagact

SEQ ID NO: 72823 - DNA, 15 bp, Artificial Sequence
  dgRNA
  Txnl4a
cgcgagattagactc

SEQ ID NO: 72824 - DNA, 15 bp, Artificial Sequence
  dgRNA
  Txnl4a
gtatccccgccccct

SEQ ID NO: 72825 - DNA, 15 bp, Artificial Sequence
  dgRNA
  Txnl4a
ccgccccctcggcag

SEQ ID NO: 72826 - DNA, 15 bp, Artificial Sequence
  dgRNA
  Atp6v1g1
catctctcaatgcgc

SEQ ID NO: 72827 - DNA, 15 bp, Artificial Sequence
  dgRNA
  Atp6v1g1
aatgcgcaggcgtag

SEQ ID NO: 72828 - DNA, 15 bp, Artificial Sequence
  dgRNA
  Atp6v1g1
cgtagtggaacagct

SEQ ID NO: 72829 - DNA, 15 bp, Artificial Sequence
  dgRNA
  Atp6v1g1
agtcaccggactcaa

SEQ ID NO: 72830 - DNA, 15 bp, Artificial Sequence
  dgRNA
  Olfr110
acttgctatgtctgg

SEQ ID NO: 72831 - DNA, 15 bp, Artificial Sequence
  dgRNA
  Olfr110
ttaagagcagtccta

SEQ ID NO: 72832 - DNA, 15 bp, Artificial Sequence
  dgRNA
  Dlgap5
gcgggccgcacttgt

SEQ ID NO: 72833 - DNA, 15 bp, Artificial Sequence
  dgRNA
  Vmn2r100
atcagcagactccat

SEQ ID NO: 72834 - DNA, 15 bp, Artificial Sequence
  dgRNA
  Cpne9
ccagcccaatatttc

SEQ ID NO: 72835 - DNA, 15 bp, Artificial Sequence
  dgRNA
  Cpne9
ccatggatagttcta

SEQ ID NO: 72836 - DNA, 15 bp, Artificial Sequence
  dgRNA
  Cpne9
tccccgactagctcc

SEQ ID NO: 72837 - DNA, 15 bp, Artificial Sequence
  dgRNA
  Cpne9
gctgctccaatgggg

SEQ ID NO: 72838 - DNA, 15 bp, Artificial Sequence
  dgRNA
  5730409E04Rik
gaaccaatggatccg

SEQ ID NO: 72839 - DNA, 15 bp, Artificial Sequence
  dgRNA
  5730409E04Rik
ccgtggcgcctcgcc

SEQ ID NO: 72840 - DNA, 15 bp, Artificial Sequence
  dgRNA
  5730409E04Rik
cgtggcgcctcgcca

SEQ ID NO: 72841 - DNA, 15 bp, Artificial Sequence
  dgRNA
  5730409E04Rik
ggcgcctcgccaggg

SEQ ID NO: 72842 - DNA, 15 bp, Artificial Sequence
  dgRNA
  Rpl3l
cccaggtttttccgc

SEQ ID NO: 72843 - DNA, 15 bp, Artificial Sequence
  dgRNA
  Rpl3l
gccaggtgctaaatc

SEQ ID NO: 72844 - DNA, 15 bp, Artificial Sequence
  dgRNA
  Rpl3l
ccaggtgctaaatct

SEQ ID NO: 72845 - DNA, 15 bp, Artificial Sequence
  dgRNA
  Rpl3l
gctaaatctgggatc

SEQ ID NO: 72846 - DNA, 15 bp, Artificial Sequence
  dgRNA
  Cdc45
tccaaacaacttgat

SEQ ID NO: 72847 - DNA, 15 bp, Artificial Sequence
  dgRNA
  Cdc45
gagccgttctcctta

SEQ ID NO: 72848 - DNA, 15 bp, Artificial Sequence
  dgRNA
  Cdc45
ttccggcgttgatcc

SEQ ID NO: 72849 - DNA, 15 bp, Artificial Sequence
  dgRNA
  Cdc45
tgatcccggccatca

SEQ ID NO: 72850 - DNA, 15 bp, Artificial Sequence
  dgRNA
  Gca
taggagttgatggcc

SEQ ID NO: 72851 - DNA, 15 bp, Artificial Sequence
  dgRNA
  Gca
gtgggcctgtggtcg

SEQ ID NO: 72852 - DNA, 15 bp, Artificial Sequence
  dgRNA
  Gca
tgggcctgtggtcgg

SEQ ID NO: 72853 - DNA, 15 bp, Artificial Sequence
  dgRNA
  Gca
catctcacctgtgat

SEQ ID NO: 72854 - DNA, 15 bp, Artificial Sequence
  dgRNA
  Rnf225
actattcatgctagt

SEQ ID NO: 72855 - DNA, 15 bp, Artificial Sequence
  dgRNA
  Rnf225
attcatgctagtagg

SEQ ID NO: 72856 - DNA, 15 bp, Artificial Sequence
  dgRNA
  Rnf225
ttcatgctagtagga

SEQ ID NO: 72857 - DNA, 15 bp, Artificial Sequence
  dgRNA
  Rnf225
tcatgctagtaggag

SEQ ID NO: 72858 - DNA, 15 bp, Artificial Sequence
  dgRNA
  Mysm1
gtgagataacccatg

SEQ ID NO: 72859 - DNA, 15 bp, Artificial Sequence
  dgRNA
  Mysm1
acccatgcggtcctt

SEQ ID NO: 72860 - DNA, 15 bp, Artificial Sequence
  dgRNA
  Mysm1
cccatgcggtccttg

SEQ ID NO: 72861 - DNA, 15 bp, Artificial Sequence
  dgRNA
  Mysm1
tttcacgcagtctcc

SEQ ID NO: 72862 - DNA, 15 bp, Artificial Sequence
  dgRNA
  Camk1
cctgctgacgaccaa

SEQ ID NO: 72863 - DNA, 15 bp, Artificial Sequence
  dgRNA
  Camk1
ctgctgacgaccaaa

SEQ ID NO: 72864 - DNA, 15 bp, Artificial Sequence
  dgRNA
  Camk1
cataagcatgctata

SEQ ID NO: 72865 - DNA, 15 bp, Artificial Sequence
  dgRNA
  Camk1
tcgtccctagtcccc

SEQ ID NO: 72866 - DNA, 15 bp, Artificial Sequence
  dgRNA
  Pym1
ttctctccgagccct

SEQ ID NO: 72867 - DNA, 15 bp, Artificial Sequence
  dgRNA
  Pym1
tctctccgagcccta

SEQ ID NO: 72868 - DNA, 15 bp, Artificial Sequence
  dgRNA
  Pym1
ggtcaacagtggcgt

SEQ ID NO: 72869 - DNA, 15 bp, Artificial Sequence
  dgRNA
  Pym1
caacagtggcgtcgg

SEQ ID NO: 72870 - DNA, 15 bp, Artificial Sequence
  dgRNA
  Arfgap1
aaagcgcgacgtagc

SEQ ID NO: 72871 - DNA, 15 bp, Artificial Sequence
  dgRNA
  Mtl5
ccgttcagtcagaga

SEQ ID NO: 72872 - DNA, 15 bp, Artificial Sequence
  dgRNA
  Mtl5
cgttcagtcagagac

SEQ ID NO: 72873 - DNA, 15 bp, Artificial Sequence
  dgRNA
  Mtl5
cgcccctttccctaa

SEQ ID NO: 72874 - DNA, 15 bp, Artificial Sequence
  dgRNA
  Mtl5
ttccctaacggtcaa

SEQ ID NO: 72875 - DNA, 15 bp, Artificial Sequence
  dgRNA
  BC053393
gtcacacttcaagtg

SEQ ID NO: 72876 - DNA, 15 bp, Artificial Sequence
  dgRNA
  BC053393
atgtacccaattact

SEQ ID NO: 72877 - DNA, 15 bp, Artificial Sequence
  dgRNA
  BC053393
agggactttgacacc

SEQ ID NO: 72878 - DNA, 15 bp, Artificial Sequence
  dgRNA
  BC053393
ttgaagtgtgactat

SEQ ID NO: 72879 - DNA, 15 bp, Artificial Sequence
  dgRNA
  Gdf11
gggccggggctataa

SEQ ID NO: 72880 - DNA, 15 bp, Artificial Sequence
  dgRNA
  Gdf11
ggccggggctataaa

SEQ ID NO: 72881 - DNA, 15 bp, Artificial Sequence
  dgRNA
  Gdf11
ataaagggcccggcc

SEQ ID NO: 72882 - DNA, 15 bp, Artificial Sequence
  dgRNA
  Gdf11
taaagggcccggccc

SEQ ID NO: 72883 - DNA, 15 bp, Artificial Sequence
  dgRNA
  Igfbp2
cgtagggtgggcgag

SEQ ID NO: 72884 - DNA, 15 bp, Artificial Sequence
  dgRNA
  Igfbp2
cctcacgcaagagtg

SEQ ID NO: 72885 - DNA, 15 bp, Artificial Sequence
  dgRNA
  Igfbp2
ctcacgcaagagtgc

SEQ ID NO: 72886 - DNA, 15 bp, Artificial Sequence
  dgRNA
  Igfbp2
tcacgcaagagtgcg

SEQ ID NO: 72887 - DNA, 15 bp, Artificial Sequence
  dgRNA
  Adgrb1
gctttcctgctgcgt

SEQ ID NO: 72888 - DNA, 15 bp, Artificial Sequence
  dgRNA
  Adgrb1
ctctaatgtgtgatc

SEQ ID NO: 72889 - DNA, 15 bp, Artificial Sequence
  dgRNA
  Adgrb1
catctgggtgacaag

SEQ ID NO: 72890 - DNA, 15 bp, Artificial Sequence
  dgRNA
  Adgrb1
aggagtgcgacgctc

SEQ ID NO: 72891 - DNA, 15 bp, Artificial Sequence
  dgRNA
  Snx3
agctaaaatcgtttc

SEQ ID NO: 72892 - DNA, 15 bp, Artificial Sequence
  dgRNA
  Snx3
tccccgcagagaagc

SEQ ID NO: 72893 - DNA, 15 bp, Artificial Sequence
  dgRNA
  Snx3
ccccgcagagaagct

SEQ ID NO: 72894 - DNA, 15 bp, Artificial Sequence
  dgRNA
  Snx3
cgcctgcgcgtcact

SEQ ID NO: 72895 - DNA, 15 bp, Artificial Sequence
  dgRNA
  Zyg11a
agagcgaggaccatt

SEQ ID NO: 72896 - DNA, 15 bp, Artificial Sequence
  dgRNA
  Zyg11a
ggaccattgggcgtg

SEQ ID NO: 72897 - DNA, 15 bp, Artificial Sequence
  dgRNA
  Zyg11a
ccattgggcgtgcgg

SEQ ID NO: 72898 - DNA, 15 bp, Artificial Sequence
  dgRNA
  Zyg11a
cattgggcgtgcggc

SEQ ID NO: 72899 - DNA, 15 bp, Artificial Sequence
  dgRNA
  Cyp2c44
gggcgttccctgcct

SEQ ID NO: 72900 - DNA, 15 bp, Artificial Sequence
  dgRNA
  Cyp2c44
tgggcgttccctgcc

SEQ ID NO: 72901 - DNA, 15 bp, Artificial Sequence
  dgRNA
  Rpl6
accacatgagtcgca

SEQ ID NO: 72902 - DNA, 15 bp, Artificial Sequence
  dgRNA
  Rpl6
ctgcccttacctatt

SEQ ID NO: 72903 - DNA, 15 bp, Artificial Sequence
  dgRNA
  Rpl6
tgcccttacctatta

SEQ ID NO: 72904 - DNA, 15 bp, Artificial Sequence
  dgRNA
  Rpl6
ccttacctattaggg

SEQ ID NO: 72905 - DNA, 15 bp, Artificial Sequence
  dgRNA
  Trpm1
ctcctaaaaaccttg

SEQ ID NO: 72906 - DNA, 15 bp, Artificial Sequence
  dgRNA
  Trpm1
tcctaaaaaccttgc

SEQ ID NO: 72907 - DNA, 15 bp, Artificial Sequence
  dgRNA
  Trpm1
cctaaaaaccttgcg

SEQ ID NO: 72908 - DNA, 15 bp, Artificial Sequence
  dgRNA
  Trpm1
ctaaaaaccttgcgg

SEQ ID NO: 72909 - DNA, 15 bp, Artificial Sequence
  dgRNA
  Cplx1
ttctcccagcgtttc

SEQ ID NO: 72910 - DNA, 15 bp, Artificial Sequence
  dgRNA
  Cplx1
tcccagcgtttcagg

SEQ ID NO: 72911 - DNA, 15 bp, Artificial Sequence
  dgRNA
  Cplx1
cccagcgtttcagga

SEQ ID NO: 72912 - DNA, 15 bp, Artificial Sequence
  dgRNA
  Cplx1
ggagggcgcttcagt

SEQ ID NO: 72913 - DNA, 15 bp, Artificial Sequence
  dgRNA
  Poglut1
aatgtgccacccgaa

SEQ ID NO: 72914 - DNA, 15 bp, Artificial Sequence
  dgRNA
  Poglut1
atgtgccacccgaat

SEQ ID NO: 72915 - DNA, 15 bp, Artificial Sequence
  dgRNA
  Poglut1
cttatttcccatgcc

SEQ ID NO: 72916 - DNA, 15 bp, Artificial Sequence
  dgRNA
  Poglut1
gctcccggaggccta

SEQ ID NO: 72917 - DNA, 15 bp, Artificial Sequence
  dgRNA
  Oxr1
tgcgtctttaaactt

SEQ ID NO: 72918 - DNA, 15 bp, Artificial Sequence
  dgRNA
  Oxr1
aacctaacttgagct

SEQ ID NO: 72919 - DNA, 15 bp, Artificial Sequence
  dgRNA
  Oxr1
acctaacttgagctt

SEQ ID NO: 72920 - DNA, 15 bp, Artificial Sequence
  dgRNA
  Oxr1
ggactatctgttcaa

SEQ ID NO: 72921 - DNA, 15 bp, Artificial Sequence
  dgRNA
  Sdc3
gagcaggttctcccg

SEQ ID NO: 72922 - DNA, 15 bp, Artificial Sequence
  dgRNA
  Sdc3
cccgcggctcgcaca

SEQ ID NO: 72923 - DNA, 15 bp, Artificial Sequence
  dgRNA
  Sdc3
acacggcgtgcttcg

SEQ ID NO: 72924 - DNA, 15 bp, Artificial Sequence
  dgRNA
  Sdc3
tcgcggatccacagt

SEQ ID NO: 72925 - DNA, 15 bp, Artificial Sequence
  dgRNA
  Gpat4
tgaacctcgccatgc

SEQ ID NO: 72926 - DNA, 15 bp, Artificial Sequence
  dgRNA
  Gpat4
gaacctcgccatgcc

SEQ ID NO: 72927 - DNA, 15 bp, Artificial Sequence
  dgRNA
  Gpat4
gaacgatgcctgttc

SEQ ID NO: 72928 - DNA, 15 bp, Artificial Sequence
  dgRNA
  Gpat4
cagacaggccccggt

SEQ ID NO: 72929 - DNA, 15 bp, Artificial Sequence
  dgRNA
  Lce1m
gcttgcaattctcag

SEQ ID NO: 72930 - DNA, 15 bp, Artificial Sequence
  dgRNA
  Lce1m
ctcagatgcttatag

SEQ ID NO: 72931 - DNA, 15 bp, Artificial Sequence
  dgRNA
  Lce1m
gatgcttatagaggg

SEQ ID NO: 72932 - DNA, 15 bp, Artificial Sequence
  dgRNA
  Lce1m
gaggaattagatctt

SEQ ID NO: 72933 - DNA, 15 bp, Artificial Sequence
  dgRNA
  Cdnf
tcactccgcgctcct

SEQ ID NO: 72934 - DNA, 15 bp, Artificial Sequence
  dgRNA
  Cdnf
cactccgcgctcctt

SEQ ID NO: 72935 - DNA, 15 bp, Artificial Sequence
  dgRNA
  Cdnf
cgctccttgggagcc

SEQ ID NO: 72936 - DNA, 15 bp, Artificial Sequence
  dgRNA
  Cdnf
gcccggcgtaaacgc

SEQ ID NO: 72937 - DNA, 15 bp, Artificial Sequence
  dgRNA
  Xylt2
agatcctccgcactc

SEQ ID NO: 72938 - DNA, 15 bp, Artificial Sequence
  dgRNA
  Xylt2
gatcctccgcactcc

SEQ ID NO: 72939 - DNA, 15 bp, Artificial Sequence
  dgRNA
  Xylt2
aatgcttttgcggtc

SEQ ID NO: 72940 - DNA, 15 bp, Artificial Sequence
  dgRNA
  Xylt2
cgcccagcccacgag

SEQ ID NO: 72941 - DNA, 15 bp, Artificial Sequence
  dgRNA
  Kdm4a
ctgataggctaactc

SEQ ID NO: 72942 - DNA, 15 bp, Artificial Sequence
  dgRNA
  Trim38
atttaagtttaggtg

SEQ ID NO: 72943 - DNA, 15 bp, Artificial Sequence
  dgRNA
  Trim38
tctgattgccacatt

SEQ ID NO: 72944 - DNA, 15 bp, Artificial Sequence
  dgRNA
  Trim38
ggctactgggtttag

SEQ ID NO: 72945 - DNA, 15 bp, Artificial Sequence
  dgRNA
  Trim38
caactgacggctact

SEQ ID NO: 72946 - DNA, 15 bp, Artificial Sequence
  dgRNA
  Bmp2
ccgcagctgtgggcg

SEQ ID NO: 72947 - DNA, 15 bp, Artificial Sequence
  dgRNA
  Bmp2
tgtgggcgcggatcc

SEQ ID NO: 72948 - DNA, 15 bp, Artificial Sequence
  dgRNA
  Bmp2
cgcggatccaggtcc

SEQ ID NO: 72949 - DNA, 15 bp, Artificial Sequence
  dgRNA
  Bmp2
gcggatccaggtccc

SEQ ID NO: 72950 - DNA, 15 bp, Artificial Sequence
  dgRNA
  Itga2b
caggcagcgaattca

SEQ ID NO: 72951 - DNA, 15 bp, Artificial Sequence
  dgRNA
  Itga2b
tggttatactttccc

SEQ ID NO: 72952 - DNA, 15 bp, Artificial Sequence
  dgRNA
  Itga2b
ggattgccgggcttg

SEQ ID NO: 72953 - DNA, 15 bp, Artificial Sequence
  dgRNA
  Itga2b
catgaattcgctgcc

SEQ ID NO: 72954 - DNA, 15 bp, Artificial Sequence
  dgRNA
  Zbtb6
cgcccctcaactcct

SEQ ID NO: 72955 - DNA, 15 bp, Artificial Sequence
  dgRNA
  Zbtb6
gctccttggcggttc

SEQ ID NO: 72956 - DNA, 15 bp, Artificial Sequence
  dgRNA
  Zbtb6
caaacagcttcatac

SEQ ID NO: 72957 - DNA, 15 bp, Artificial Sequence
  dgRNA
  Zbtb6
gcttcataccggagc

SEQ ID NO: 72958 - DNA, 15 bp, Artificial Sequence
  dgRNA
  Adgra3
cggcgccaggaaacg

SEQ ID NO: 72959 - DNA, 15 bp, Artificial Sequence
  dgRNA
  Adgra3
agaactttcttccgc

SEQ ID NO: 72960 - DNA, 15 bp, Artificial Sequence
  dgRNA
  Adgra3
gaactttcttccgct

SEQ ID NO: 72961 - DNA, 15 bp, Artificial Sequence
  dgRNA
  Adgra3
tcttccgctgggtcc

SEQ ID NO: 72962 - DNA, 15 bp, Artificial Sequence
  dgRNA
  Olfr1061
acctttattcagaac

SEQ ID NO: 72963 - DNA, 15 bp, Artificial Sequence
  dgRNA
  Zfp933
atttgccagcgcgaa

SEQ ID NO: 72964 - DNA, 15 bp, Artificial Sequence
  dgRNA
  Zfp933
agtcacgtgttacag

SEQ ID NO: 72965 - DNA, 15 bp, Artificial Sequence
  dgRNA
  Zfp933
gaacttacgtagttc

SEQ ID NO: 72966 - DNA, 15 bp, Artificial Sequence
  dgRNA
  Zfp933
aacttacgtagttcc

SEQ ID NO: 72967 - DNA, 15 bp, Artificial Sequence
  dgRNA
  Wtap
gctgtctccccgttc

SEQ ID NO: 72968 - DNA, 15 bp, Artificial Sequence
  dgRNA
  Wtap
ttccggcacgatgcg

SEQ ID NO: 72969 - DNA, 15 bp, Artificial Sequence
  dgRNA
  Wtap
caatcacgcgcttgt

SEQ ID NO: 72970 - DNA, 15 bp, Artificial Sequence
  dgRNA
  Wtap
acgcgcttgtcggct

SEQ ID NO: 72971 - DNA, 15 bp, Artificial Sequence
  dgRNA
  Dot1l
cgtaagtgcgtgcgt

SEQ ID NO: 72972 - DNA, 15 bp, Artificial Sequence
  dgRNA
  Dot1l
agtgcgtgcgtcggt

SEQ ID NO: 72973 - DNA, 15 bp, Artificial Sequence
  dgRNA
  Dot1l
gcgtgcgtcggtcgg

SEQ ID NO: 72974 - DNA, 15 bp, Artificial Sequence
  dgRNA
  Dot1l
tgcgtcggtcggagg

SEQ ID NO: 72975 - DNA, 15 bp, Artificial Sequence
  dgRNA
  Ercc2
tcctcagcgatgcct

SEQ ID NO: 72976 - DNA, 15 bp, Artificial Sequence
  dgRNA
  Ercc2
cctcagcgatgcctc

SEQ ID NO: 72977 - DNA, 15 bp, Artificial Sequence
  dgRNA
  Ercc2
cgccaattttccgat

SEQ ID NO: 72978 - DNA, 15 bp, Artificial Sequence
  dgRNA
  Ercc2
cgattggcagagtga

SEQ ID NO: 72979 - DNA, 15 bp, Artificial Sequence
  dgRNA
  Cped1
ctaattctgcgggtc

SEQ ID NO: 72980 - DNA, 15 bp, Artificial Sequence
  dgRNA
  Cped1
tctgcgggtctggat

SEQ ID NO: 72981 - DNA, 15 bp, Artificial Sequence
  dgRNA
  Cped1
agccacgttccaagt

SEQ ID NO: 72982 - DNA, 15 bp, Artificial Sequence
  dgRNA
  Cped1
gccacgttccaagtt

SEQ ID NO: 72983 - DNA, 15 bp, Artificial Sequence
  dgRNA
  Olfr813
cctatgcttgtcttg

SEQ ID NO: 72984 - DNA, 15 bp, Artificial Sequence
  dgRNA
  Mcc
cctgctctcccggca

SEQ ID NO: 72985 - DNA, 15 bp, Artificial Sequence
  dgRNA
  Mcc
ccgtgccgggagagc

SEQ ID NO: 72986 - DNA, 15 bp, Artificial Sequence
  dgRNA
  Mcc
agaggagaccgtgcc

SEQ ID NO: 72987 - DNA, 15 bp, Artificial Sequence
  dgRNA
  Mcc
ctgcgcggcggaggc

SEQ ID NO: 72988 - DNA, 15 bp, Artificial Sequence
  dgRNA
  Pax6
ccgaccaattgcacc

SEQ ID NO: 72989 - DNA, 15 bp, Artificial Sequence
  dgRNA
  Pax6
ccaattgcaccaggc

SEQ ID NO: 72990 - DNA, 15 bp, Artificial Sequence
  dgRNA
  Pax6
caattgcaccaggca

SEQ ID NO: 72991 - DNA, 15 bp, Artificial Sequence
  dgRNA
  Pax6
gagggagcatccaat

SEQ ID NO: 72992 - DNA, 15 bp, Artificial Sequence
  dgRNA
  Ndufs4
gattactttctatag

SEQ ID NO: 72993 - DNA, 15 bp, Artificial Sequence
  dgRNA
  Ndufs4
gtcctcaatcgcaaa

SEQ ID NO: 72994 - DNA, 15 bp, Artificial Sequence
  dgRNA
  Ndufs4
ttgctttgagaacgg

SEQ ID NO: 72995 - DNA, 15 bp, Artificial Sequence
  dgRNA
  Ndufs4
taatccttgttagta

SEQ ID NO: 72996 - DNA, 15 bp, Artificial Sequence
  dgRNA
  Bnc1
gtcgcccgcagcccc

SEQ ID NO: 72997 - DNA, 15 bp, Artificial Sequence
  dgRNA
  Bnc1
cccggcggccggagt

SEQ ID NO: 72998 - DNA, 15 bp, Artificial Sequence
  dgRNA
  Bnc1
ccggcggccggagta

SEQ ID NO: 72999 - DNA, 15 bp, Artificial Sequence
  dgRNA
  Bnc1
cggcggccggagtag

SEQ ID NO: 73000 - DNA, 15 bp, Artificial Sequence
  dgRNA
  L3mbtl4
catccaccagggtgc

SEQ ID NO: 73001 - DNA, 15 bp, Artificial Sequence
  dgRNA
  L3mbtl4
gcagggcgtgcgact

SEQ ID NO: 73002 - DNA, 15 bp, Artificial Sequence
  dgRNA
  L3mbtl4
agacagtgcgagggt

SEQ ID NO: 73003 - DNA, 15 bp, Artificial Sequence
  dgRNA
  L3mbtl4
gatggcagcatcacc

SEQ ID NO: 73004 - DNA, 15 bp, Artificial Sequence
  dgRNA
  Thsd4
tgtggagcgtgcatc

SEQ ID NO: 73005 - DNA, 15 bp, Artificial Sequence
  dgRNA
  Thsd4
ataacttctcctggc

SEQ ID NO: 73006 - DNA, 15 bp, Artificial Sequence
  dgRNA
  Tmem202
acaggctctataccc

SEQ ID NO: 73007 - DNA, 15 bp, Artificial Sequence
  dgRNA
  Fign
cgacgcccggccgcg

SEQ ID NO: 73008 - DNA, 15 bp, Artificial Sequence
  dgRNA
  Fign
ttgaatttggctcgg

SEQ ID NO: 73009 - DNA, 15 bp, Artificial Sequence
  dgRNA
  Fign
ccgggagccccggga

SEQ ID NO: 73010 - DNA, 15 bp, Artificial Sequence
  dgRNA
  Fign
gccgggagccccggg

SEQ ID NO: 73011 - DNA, 15 bp, Artificial Sequence
  dgRNA
  Zbtb18
agtctgccaacattt

SEQ ID NO: 73012 - DNA, 15 bp, Artificial Sequence
  dgRNA
  Zbtb18
tgccattatctccgc

SEQ ID NO: 73013 - DNA, 15 bp, Artificial Sequence
  dgRNA
  Zbtb18
gccattatctccgca

SEQ ID NO: 73014 - DNA, 15 bp, Artificial Sequence
  dgRNA
  Zbtb18
ccattatctccgcag

SEQ ID NO: 73015 - DNA, 15 bp, Artificial Sequence
  dgRNA
  Olfr378
ggtcactgatagaaa

SEQ ID NO: 73016 - DNA, 15 bp, Artificial Sequence
  dgRNA
  Olfr378
agttacttcatcacc

SEQ ID NO: 73017 - DNA, 15 bp, Artificial Sequence
  dgRNA
  Olfr378
gatgaatacacttag

SEQ ID NO: 73018 - DNA, 15 bp, Artificial Sequence
  dgRNA
  Olfr378
atccaggacctctac

SEQ ID NO: 73019 - DNA, 15 bp, Artificial Sequence
  dgRNA
  Lcor
gcagactttgtgatt

SEQ ID NO: 73020 - DNA, 15 bp, Artificial Sequence
  dgRNA
  Lcor
acctgagttaaaagt

SEQ ID NO: 73021 - DNA, 15 bp, Artificial Sequence
  dgRNA
  Lcor
attatgtctgttgag

SEQ ID NO: 73022 - DNA, 15 bp, Artificial Sequence
  dgRNA
  Lcor
ccccacttttaactc

SEQ ID NO: 73023 - DNA, 15 bp, Artificial Sequence
  dgRNA
  Pnrc2
gaaagtccagcagcg

SEQ ID NO: 73024 - DNA, 15 bp, Artificial Sequence
  dgRNA
  Pnrc2
gcgcggctcccgaag

SEQ ID NO: 73025 - DNA, 15 bp, Artificial Sequence
  dgRNA
  Pnrc2
cgcggctcccgaagc

SEQ ID NO: 73026 - DNA, 15 bp, Artificial Sequence
  dgRNA
  Pnrc2
gcgtgccccagcaac

SEQ ID NO: 73027 - DNA, 15 bp, Artificial Sequence
  dgRNA
  Ccdc109b
caagcgaagtcaaag

SEQ ID NO: 73028 - DNA, 15 bp, Artificial Sequence
  dgRNA
  Ccdc109b
agcgaagtcaaagcg

SEQ ID NO: 73029 - DNA, 15 bp, Artificial Sequence
  dgRNA
  Ccdc109b
tgtcgccgccccagt

SEQ ID NO: 73030 - DNA, 15 bp, Artificial Sequence
  dgRNA
  Ccdc109b
cgccgccccagtcgg

SEQ ID NO: 73031 - DNA, 15 bp, Artificial Sequence
  dgRNA
  Bpifa2
caagtttgacaacat

SEQ ID NO: 73032 - DNA, 15 bp, Artificial Sequence
  dgRNA
  Bpifa2
aagtttgacaacata

SEQ ID NO: 73033 - DNA, 15 bp, Artificial Sequence
  dgRNA
  Bpifa2
atagggctttgaact

SEQ ID NO: 73034 - DNA, 15 bp, Artificial Sequence
  dgRNA
  Bpifa2
gagactgccaacaag

SEQ ID NO: 73035 - DNA, 15 bp, Artificial Sequence
  dgRNA
  Sfmbt1
gagtcttccttgagt

SEQ ID NO: 73036 - DNA, 15 bp, Artificial Sequence
  dgRNA
  Sfmbt1
gtctcattggcactc

SEQ ID NO: 73037 - DNA, 15 bp, Artificial Sequence
  dgRNA
  Sfmbt1
tctcattggcactcc

SEQ ID NO: 73038 - DNA, 15 bp, Artificial Sequence
  dgRNA
  Sfmbt1
actccgggatcccac

SEQ ID NO: 73039 - DNA, 15 bp, Artificial Sequence
  dgRNA
  Ccdc22
ggctagcaagacacg

SEQ ID NO: 73040 - DNA, 15 bp, Artificial Sequence
  dgRNA
  Ccdc22
gctagcaagacacgg

SEQ ID NO: 73041 - DNA, 15 bp, Artificial Sequence
  dgRNA
  Angptl3
gatctaactcaacat

SEQ ID NO: 73042 - DNA, 15 bp, Artificial Sequence
  dgRNA
  Angptl3
tgagcaactaatagg

SEQ ID NO: 73043 - DNA, 15 bp, Artificial Sequence
  dgRNA
  Kif13a
gcggtgctgcgcgct

SEQ ID NO: 73044 - DNA, 15 bp, Artificial Sequence
  dgRNA
  Kif13a
gctgcgcgctcggcc

SEQ ID NO: 73045 - DNA, 15 bp, Artificial Sequence
  dgRNA
  Kif13a
cccgagcggctagag

SEQ ID NO: 73046 - DNA, 15 bp, Artificial Sequence
  dgRNA
  Kif13a
ggctagagcggcgct

SEQ ID NO: 73047 - DNA, 15 bp, Artificial Sequence
  dgRNA
  Tnfrsf19
tgtaatactttcacc

SEQ ID NO: 73048 - DNA, 15 bp, Artificial Sequence
  dgRNA
  Tnfrsf19
gggagccgcgcgcgt

SEQ ID NO: 73049 - DNA, 15 bp, Artificial Sequence
  dgRNA
  Tnfrsf19
ggagccgcgcgcgtg

SEQ ID NO: 73050 - DNA, 15 bp, Artificial Sequence
  dgRNA
  Tnfrsf19
ccgcgcgcgtggggt

SEQ ID NO: 73051 - DNA, 15 bp, Artificial Sequence
  dgRNA
  Npy4r
tagtttgcctgcaag

SEQ ID NO: 73052 - DNA, 15 bp, Artificial Sequence
  dgRNA
  Npy4r
cagcacctcgcctcc

SEQ ID NO: 73053 - DNA, 15 bp, Artificial Sequence
  dgRNA
  Npy4r
agcacctcgcctcct

SEQ ID NO: 73054 - DNA, 15 bp, Artificial Sequence
  dgRNA
  Npy4r
gcacctcgcctcctg

SEQ ID NO: 73055 - DNA, 15 bp, Artificial Sequence
  dgRNA
  Taf6l
gaagctgcccatgat

SEQ ID NO: 73056 - DNA, 15 bp, Artificial Sequence
  dgRNA
  Taf6l
catgatcggccgtac

SEQ ID NO: 73057 - DNA, 15 bp, Artificial Sequence
  dgRNA
  Taf6l
gccgtaccggccgcc

SEQ ID NO: 73058 - DNA, 15 bp, Artificial Sequence
  dgRNA
  Taf6l
cgcccggcccgccgc

SEQ ID NO: 73059 - DNA, 15 bp, Artificial Sequence
  dgRNA
  Josd2
tgacgacatagaggt

SEQ ID NO: 73060 - DNA, 15 bp, Artificial Sequence
  dgRNA
  Josd2
gtgacgacatagagg

SEQ ID NO: 73061 - DNA, 15 bp, Artificial Sequence
  dgRNA
  Josd2
agcgtgacgacatag

SEQ ID NO: 73062 - DNA, 15 bp, Artificial Sequence
  dgRNA
  Rasal1
cggcaggagacaccc

SEQ ID NO: 73063 - DNA, 15 bp, Artificial Sequence
  dgRNA
  Rasal1
cacccgggttcttgg

SEQ ID NO: 73064 - DNA, 15 bp, Artificial Sequence
  dgRNA
  Rasal1
acccgggttcttgga

SEQ ID NO: 73065 - DNA, 15 bp, Artificial Sequence
  dgRNA
  Rasal1
ttgacccatagcgcc

SEQ ID NO: 73066 - DNA, 15 bp, Artificial Sequence
  dgRNA
  Il27ra
tgtcgccactgtccc

SEQ ID NO: 73067 - DNA, 15 bp, Artificial Sequence
  dgRNA
  Il27ra
cgtgcgtatcattgc

SEQ ID NO: 73068 - DNA, 15 bp, Artificial Sequence
  dgRNA
  Il27ra
gtgcgtatcattgct

SEQ ID NO: 73069 - DNA, 15 bp, Artificial Sequence
  dgRNA
  Il27ra
tgcgtatcattgctg

SEQ ID NO: 73070 - DNA, 15 bp, Artificial Sequence
  dgRNA
  Slc33a1
cgctgcagtgtcagc

SEQ ID NO: 73071 - DNA, 15 bp, Artificial Sequence
  dgRNA
  Slc33a1
tccgtcgcagcgcca

SEQ ID NO: 73072 - DNA, 15 bp, Artificial Sequence
  dgRNA
  Slc33a1
cgccagcctcaagcc

SEQ ID NO: 73073 - DNA, 15 bp, Artificial Sequence
  dgRNA
  Slc33a1
ccgggtgcggctgca

SEQ ID NO: 73074 - DNA, 15 bp, Artificial Sequence
  dgRNA
  Hs3st1
tggaagtcggcgctc

SEQ ID NO: 73075 - DNA, 15 bp, Artificial Sequence
  dgRNA
  Hs3st1
ggaagtcggcgctca

SEQ ID NO: 73076 - DNA, 15 bp, Artificial Sequence
  dgRNA
  Hs3st1
gctcagggactcgct

SEQ ID NO: 73077 - DNA, 15 bp, Artificial Sequence
  dgRNA
  Hs3st1
cagggactcgctggg

SEQ ID NO: 73078 - DNA, 15 bp, Artificial Sequence
  dgRNA
  9230112D13Rik
tctagacgagcgtga

SEQ ID NO: 73079 - DNA, 15 bp, Artificial Sequence
  dgRNA
  9230112D13Rik
agagttggaacgtag

SEQ ID NO: 73080 - DNA, 15 bp, Artificial Sequence
  dgRNA
  9230112D13Rik
gagttggaacgtagt

SEQ ID NO: 73081 - DNA, 15 bp, Artificial Sequence
  dgRNA
  9230112D13Rik
gacagcagcgccatg

SEQ ID NO: 73082 - DNA, 15 bp, Artificial Sequence
  dgRNA
  Dbpht2
gaaactaggtgccaa

SEQ ID NO: 73083 - DNA, 15 bp, Artificial Sequence
  dgRNA
  Dbpht2
caaagattagtgtta

SEQ ID NO: 73084 - DNA, 15 bp, Artificial Sequence
  dgRNA
  Dbpht2
gtggaaatcctgcta

SEQ ID NO: 73085 - DNA, 15 bp, Artificial Sequence
  dgRNA
  Dbpht2
tggaaatcctgctaa

SEQ ID NO: 73086 - DNA, 15 bp, Artificial Sequence
  dgRNA
  Kcnh6
acgcggacagctccc

SEQ ID NO: 73087 - DNA, 15 bp, Artificial Sequence
  dgRNA
  Kcnh6
cgggcgcaagcctcg

SEQ ID NO: 73088 - DNA, 15 bp, Artificial Sequence
  dgRNA
  Kcnh6
cgcaagcctcgtgga

SEQ ID NO: 73089 - DNA, 15 bp, Artificial Sequence
  dgRNA
  Kcnh6
aagcctcgtggaagg

SEQ ID NO: 73090 - DNA, 15 bp, Artificial Sequence
  dgRNA
  Meis3
gtctggagcttcccg

SEQ ID NO: 73091 - DNA, 15 bp, Artificial Sequence
  dgRNA
  Meis3
tatgtcagattcgcg

SEQ ID NO: 73092 - DNA, 15 bp, Artificial Sequence
  dgRNA
  Meis3
gtatgtcagattcgc

SEQ ID NO: 73093 - DNA, 15 bp, Artificial Sequence
  dgRNA
  Meis3
tgtatgtcagattcg

SEQ ID NO: 73094 - DNA, 15 bp, Artificial Sequence
  dgRNA
  Impdh1
ctgagtggcgtctca

SEQ ID NO: 73095 - DNA, 15 bp, Artificial Sequence
  dgRNA
  Impdh1
tgagtggcgtctcat

SEQ ID NO: 73096 - DNA, 15 bp, Artificial Sequence
  dgRNA
  Impdh1
gagtggcgtctcatg

SEQ ID NO: 73097 - DNA, 15 bp, Artificial Sequence
  dgRNA
  Impdh1
agtggcgtctcatgg

SEQ ID NO: 73098 - DNA, 15 bp, Artificial Sequence
  dgRNA
  Zfp493
ccctgtggttgtacc

SEQ ID NO: 73099 - DNA, 15 bp, Artificial Sequence
  dgRNA
  Zfp493
accccttacactcta

SEQ ID NO: 73100 - DNA, 15 bp, Artificial Sequence
  dgRNA
  Zfp493
ccccttacactctaa

SEQ ID NO: 73101 - DNA, 15 bp, Artificial Sequence
  dgRNA
  Zfp493
tttcgcatagagttg

SEQ ID NO: 73102 - DNA, 15 bp, Artificial Sequence
  dgRNA
  Clock
tcggctggcggctac

SEQ ID NO: 73103 - DNA, 15 bp, Artificial Sequence
  dgRNA
  Clock
ctggcggctaccggc

SEQ ID NO: 73104 - DNA, 15 bp, Artificial Sequence
  dgRNA
  Clock
ctaccggctggagag

SEQ ID NO: 73105 - DNA, 15 bp, Artificial Sequence
  dgRNA
  Clock
acggcgagagcgcga

SEQ ID NO: 73106 - DNA, 15 bp, Artificial Sequence
  dgRNA
  Igsf23
aatgttctggccctt

SEQ ID NO: 73107 - DNA, 15 bp, Artificial Sequence
  dgRNA
  Igsf23
cagtcccgtctgacg

SEQ ID NO: 73108 - DNA, 15 bp, Artificial Sequence
  dgRNA
  Igsf23
agtcccgtctgacgc

SEQ ID NO: 73109 - DNA, 15 bp, Artificial Sequence
  dgRNA
  Igsf23
cgtctgacgcgggca

SEQ ID NO: 73110 - DNA, 15 bp, Artificial Sequence
  dgRNA
  Olfr67
cagcattaacgattg

SEQ ID NO: 73111 - DNA, 15 bp, Artificial Sequence
  dgRNA
  Ssbp2
tctcgcgcgttgcca

SEQ ID NO: 73112 - DNA, 15 bp, Artificial Sequence
  dgRNA
  Ssbp2
cgcgttgccagggcg

SEQ ID NO: 73113 - DNA, 15 bp, Artificial Sequence
  dgRNA
  Ssbp2
gttgccagggcgagg

SEQ ID NO: 73114 - DNA, 15 bp, Artificial Sequence
  dgRNA
  Ssbp2
ggcggagctctggcg

SEQ ID NO: 73115 - DNA, 15 bp, Artificial Sequence
  dgRNA
  Ccnk
cgaagttccgttaac

SEQ ID NO: 73116 - DNA, 15 bp, Artificial Sequence
  dgRNA
  Ccnk
ttccgttaacaggtt

SEQ ID NO: 73117 - DNA, 15 bp, Artificial Sequence
  dgRNA
  Ccnk
aactccctttcgcca

SEQ ID NO: 73118 - DNA, 15 bp, Artificial Sequence
  dgRNA
  Ccnk
actccctttcgccaa

SEQ ID NO: 73119 - DNA, 15 bp, Artificial Sequence
  dgRNA
  Ncbp2
gctgtagcagcgcga

SEQ ID NO: 73120 - DNA, 15 bp, Artificial Sequence
  dgRNA
  Ncbp2
agctgcgccgcccgc

SEQ ID NO: 73121 - DNA, 15 bp, Artificial Sequence
  dgRNA
  Ncbp2
gcgccgcccgccgga

SEQ ID NO: 73122 - DNA, 15 bp, Artificial Sequence
  dgRNA
  Ncbp2
cgccgcccgccggat

SEQ ID NO: 73123 - DNA, 15 bp, Artificial Sequence
  dgRNA
  Cpsf6
ccatggcatgcggta

SEQ ID NO: 73124 - DNA, 15 bp, Artificial Sequence
  dgRNA
  Cpsf6
tggcatgcggtatgg

SEQ ID NO: 73125 - DNA, 15 bp, Artificial Sequence
  dgRNA
  Cpsf6
ggcatgcggtatggc

SEQ ID NO: 73126 - DNA, 15 bp, Artificial Sequence
  dgRNA
  Cpsf6
gcatgcggtatggcg

SEQ ID NO: 73127 - DNA, 15 bp, Artificial Sequence
  dgRNA
  Hyal1
ccccgccccgtgcca

SEQ ID NO: 73128 - DNA, 15 bp, Artificial Sequence
  dgRNA
  Hyal1
ccaaggccagcctat

SEQ ID NO: 73129 - DNA, 15 bp, Artificial Sequence
  dgRNA
  Hyal1
ggccagcctattggt

SEQ ID NO: 73130 - DNA, 15 bp, Artificial Sequence
  dgRNA
  Hyal1
gccagcctattggtt

SEQ ID NO: 73131 - DNA, 15 bp, Artificial Sequence
  dgRNA
  Aldoa
ttcccgtccctgcaa

SEQ ID NO: 73132 - DNA, 15 bp, Artificial Sequence
  dgRNA
  Aldoa
gcgcctttaaatgtc

SEQ ID NO: 73133 - DNA, 15 bp, Artificial Sequence
  dgRNA
  Aldoa
cgcctttaaatgtcc

SEQ ID NO: 73134 - DNA, 15 bp, Artificial Sequence
  dgRNA
  Aldoa
gcctttaaatgtccg

SEQ ID NO: 73135 - DNA, 15 bp, Artificial Sequence
  dgRNA
  Ppp1cb
ctctgcggaaccacc

SEQ ID NO: 73136 - DNA, 15 bp, Artificial Sequence
  dgRNA
  Ppp1cb
cattccagcctacgc

SEQ ID NO: 73137 - DNA, 15 bp, Artificial Sequence
  dgRNA
  Ppp1cb
ctgcgttcacaagca

SEQ ID NO: 73138 - DNA, 15 bp, Artificial Sequence
  dgRNA
  Ppp1cb
ctaacccggaaacgt

SEQ ID NO: 73139 - DNA, 15 bp, Artificial Sequence
  dgRNA
  Ispd
ccacttggtagaatc

SEQ ID NO: 73140 - DNA, 15 bp, Artificial Sequence
  dgRNA
  Ispd
aaattcttatgaccg

SEQ ID NO: 73141 - DNA, 15 bp, Artificial Sequence
  dgRNA
  Ispd
cgaggtgcacacata

SEQ ID NO: 73142 - DNA, 15 bp, Artificial Sequence
  dgRNA
  Ispd
gaggtgcacacatat

SEQ ID NO: 73143 - DNA, 15 bp, Artificial Sequence
  dgRNA
  B3gat1
tccgttgagaaactc

SEQ ID NO: 73144 - DNA, 15 bp, Artificial Sequence
  dgRNA
  B3gat1
ggtatcaacttctga

SEQ ID NO: 73145 - DNA, 15 bp, Artificial Sequence
  dgRNA
  B3gat1
ggacatggattgcag

SEQ ID NO: 73146 - DNA, 15 bp, Artificial Sequence
  dgRNA
  B3gat1
aggggcagtagtcca

SEQ ID NO: 73147 - DNA, 15 bp, Artificial Sequence
  dgRNA
  Clec4a3
gagactgtccctgcg

SEQ ID NO: 73148 - DNA, 15 bp, Artificial Sequence
  dgRNA
  Clec4a3
tgtactaggtgcctt

SEQ ID NO: 73149 - DNA, 15 bp, Artificial Sequence
  dgRNA
  Clec4a3
gtactaggtgccttt

SEQ ID NO: 73150 - DNA, 15 bp, Artificial Sequence
  dgRNA
  Clec4a3
actgtggcaccacgc

SEQ ID NO: 73151 - DNA, 15 bp, Artificial Sequence
  dgRNA
  Id2
ccaccctacaggcat

SEQ ID NO: 73152 - DNA, 15 bp, Artificial Sequence
  dgRNA
  Id2
cattggctgcgaacg

SEQ ID NO: 73153 - DNA, 15 bp, Artificial Sequence
  dgRNA
  Id2
atgggagaattcgcc

SEQ ID NO: 73154 - DNA, 15 bp, Artificial Sequence
  dgRNA
  Id2
attcgcctggtatga

SEQ ID NO: 73155 - DNA, 15 bp, Artificial Sequence
  dgRNA
  Ighmbp2
tggtctcacctgatc

SEQ ID NO: 73156 - DNA, 15 bp, Artificial Sequence
  dgRNA
  Ighmbp2
cctgatccggatccc

SEQ ID NO: 73157 - DNA, 15 bp, Artificial Sequence
  dgRNA
  Ighmbp2
ctgatccggatccct

SEQ ID NO: 73158 - DNA, 15 bp, Artificial Sequence
  dgRNA
  Ighmbp2
acaccagccgcccga

SEQ ID NO: 73159 - DNA, 15 bp, Artificial Sequence
  dgRNA
  Elf4
acggaatcctttccc

SEQ ID NO: 73160 - DNA, 15 bp, Artificial Sequence
  dgRNA
  Elf4
cggaatcctttcccc

SEQ ID NO: 73161 - DNA, 15 bp, Artificial Sequence
  dgRNA
  Elf4
aatcctttccccggg

SEQ ID NO: 73162 - DNA, 15 bp, Artificial Sequence
  dgRNA
  Elf4
cttgagtcagcggat

SEQ ID NO: 73163 - DNA, 15 bp, Artificial Sequence
  dgRNA
  Gna11
gcttcgcctcccgaa

SEQ ID NO: 73164 - DNA, 15 bp, Artificial Sequence
  dgRNA
  Gna11
aaaggaaccgagctc

SEQ ID NO: 73165 - DNA, 15 bp, Artificial Sequence
  dgRNA
  Gna11
gaccccgcccccgag

SEQ ID NO: 73166 - DNA, 15 bp, Artificial Sequence
  dgRNA
  Gna11
cgcccccgagcggcg

SEQ ID NO: 73167 - DNA, 15 bp, Artificial Sequence
  dgRNA
  Fanci
taagaaagcttaacc

SEQ ID NO: 73168 - DNA, 15 bp, Artificial Sequence
  dgRNA
  Fanci
gcgcatgctactctg

SEQ ID NO: 73169 - DNA, 15 bp, Artificial Sequence
  dgRNA
  Fanci
ccaaagcgtgtgagc

SEQ ID NO: 73170 - DNA, 15 bp, Artificial Sequence
  dgRNA
  Fanci
cctctcccgcgaatt

SEQ ID NO: 73171 - DNA, 15 bp, Artificial Sequence
  dgRNA
  Lcmt2
tgttaccgaagcagc

SEQ ID NO: 73172 - DNA, 15 bp, Artificial Sequence
  dgRNA
  Lcmt2
agctggcgtgttccc

SEQ ID NO: 73173 - DNA, 15 bp, Artificial Sequence
  dgRNA
  Lcmt2
caggaaaacgtaatt

SEQ ID NO: 73174 - DNA, 15 bp, Artificial Sequence
  dgRNA
  Lcmt2
aaacgtaatttggaa

SEQ ID NO: 73175 - DNA, 15 bp, Artificial Sequence
  dgRNA
  Cyp2d40
agcatgctcagctcg

SEQ ID NO: 73176 - DNA, 15 bp, Artificial Sequence
  dgRNA
  Cyp2d40
gctcagctcgtggaa

SEQ ID NO: 73177 - DNA, 15 bp, Artificial Sequence
  dgRNA
  Cyp2d40
ggacactcctttata

SEQ ID NO: 73178 - DNA, 15 bp, Artificial Sequence
  dgRNA
  Cyp2d40
taggctaaatatggt

SEQ ID NO: 73179 - DNA, 15 bp, Artificial Sequence
  dgRNA
  Fam63a
caaaaaaagcatacg

SEQ ID NO: 73180 - DNA, 15 bp, Artificial Sequence
  dgRNA
  Fam63a
agcatacggggaaga

SEQ ID NO: 73181 - DNA, 15 bp, Artificial Sequence
  dgRNA
  Fam63a
gcatacggggaagaa

SEQ ID NO: 73182 - DNA, 15 bp, Artificial Sequence
  dgRNA
  Fam63a
tccgccctgctttct

SEQ ID NO: 73183 - DNA, 15 bp, Artificial Sequence
  dgRNA
  Agmat
tgcaatgacaaacct

SEQ ID NO: 73184 - DNA, 15 bp, Artificial Sequence
  dgRNA
  Agmat
gcaatgacaaacctg

SEQ ID NO: 73185 - DNA, 15 bp, Artificial Sequence
  dgRNA
  Agmat
atgacaaacctgggg

SEQ ID NO: 73186 - DNA, 15 bp, Artificial Sequence
  dgRNA
  Agmat
tggggagcctcgact

SEQ ID NO: 73187 - DNA, 15 bp, Artificial Sequence
  dgRNA
  Oaz1
cgacgcatataaaag

SEQ ID NO: 73188 - DNA, 15 bp, Artificial Sequence
  dgRNA
  Oaz1
gacgcatataaaagt

SEQ ID NO: 73189 - DNA, 15 bp, Artificial Sequence
  dgRNA
  Oaz1
agtgggcgtcggcgc

SEQ ID NO: 73190 - DNA, 15 bp, Artificial Sequence
  dgRNA
  Oaz1
ttatatgcgtcgtca

SEQ ID NO: 73191 - DNA, 15 bp, Artificial Sequence
  dgRNA
  Atf4
tgacagtctggcgcc

SEQ ID NO: 73192 - DNA, 15 bp, Artificial Sequence
  dgRNA
  Atf4
ggcgcccggaacctc

SEQ ID NO: 73193 - DNA, 15 bp, Artificial Sequence
  dgRNA
  Atf4
gcccggaacctctgg

SEQ ID NO: 73194 - DNA, 15 bp, Artificial Sequence
  dgRNA
  Atf4
gatcctagagcgccc

SEQ ID NO: 73195 - DNA, 15 bp, Artificial Sequence
  dgRNA
  Kcnt1
cactgtgctgcgcgt

SEQ ID NO: 73196 - DNA, 15 bp, Artificial Sequence
  dgRNA
  Kcnt1
actgtgctgcgcgtt

SEQ ID NO: 73197 - DNA, 15 bp, Artificial Sequence
  dgRNA
  Kcnt1
ctgtgctgcgcgttg

SEQ ID NO: 73198 - DNA, 15 bp, Artificial Sequence
  dgRNA
  Kcnt1
tgtgctgcgcgttgg

SEQ ID NO: 73199 - DNA, 15 bp, Artificial Sequence
  dgRNA
  Schip1
aattcattcctgagt

SEQ ID NO: 73200 - DNA, 15 bp, Artificial Sequence
  dgRNA
  Schip1
tcgtctccctgtctg

SEQ ID NO: 73201 - DNA, 15 bp, Artificial Sequence
  dgRNA
  Schip1
cgtctccctgtctgt

SEQ ID NO: 73202 - DNA, 15 bp, Artificial Sequence
  dgRNA
  Schip1
gcgagctcaactcaa

SEQ ID NO: 73203 - DNA, 15 bp, Artificial Sequence
  dgRNA
  Cfap161
cgcctagggaacatt

SEQ ID NO: 73204 - DNA, 15 bp, Artificial Sequence
  dgRNA
  Cfap161
acagtgtcccccgtc

SEQ ID NO: 73205 - DNA, 15 bp, Artificial Sequence
  dgRNA
  Cfap161
cagtgtcccccgtca

SEQ ID NO: 73206 - DNA, 15 bp, Artificial Sequence
  dgRNA
  Cfap161
agtgtcccccgtcag

SEQ ID NO: 73207 - DNA, 15 bp, Artificial Sequence
  dgRNA
  Gm13088
gacatactctccaaa

SEQ ID NO: 73208 - DNA, 15 bp, Artificial Sequence
  dgRNA
  Gm13088
tctaagcttcaggtc

SEQ ID NO: 73209 - DNA, 15 bp, Artificial Sequence
  dgRNA
  Mrgprb2
agttcttatgatcaa

SEQ ID NO: 73210 - DNA, 15 bp, Artificial Sequence
  dgRNA
  Mrgprb2
ttatgatcaaaggac

SEQ ID NO: 73211 - DNA, 15 bp, Artificial Sequence
  dgRNA
  Mrgprb2
aaggagtccaagtac

SEQ ID NO: 73212 - DNA, 15 bp, Artificial Sequence
  dgRNA
  Traf1
attggcagagtttac

SEQ ID NO: 73213 - DNA, 15 bp, Artificial Sequence
  dgRNA
  Traf1
ttggcagagtttacc

SEQ ID NO: 73214 - DNA, 15 bp, Artificial Sequence
  dgRNA
  Traf1
gagtttaccgggtgc

SEQ ID NO: 73215 - DNA, 15 bp, Artificial Sequence
  dgRNA
  Traf1
gccttgcggcacttc

SEQ ID NO: 73216 - DNA, 15 bp, Artificial Sequence
  dgRNA
  Hpca
gattgttaccagagc

SEQ ID NO: 73217 - DNA, 15 bp, Artificial Sequence
  dgRNA
  Hpca
gggagagtcccttac

SEQ ID NO: 73218 - DNA, 15 bp, Artificial Sequence
  dgRNA
  Hpca
gagtcccttacaggc

SEQ ID NO: 73219 - DNA, 15 bp, Artificial Sequence
  dgRNA
  Hpca
cttagaggcgctgat

SEQ ID NO: 73220 - DNA, 15 bp, Artificial Sequence
  dgRNA
  Cmtm2b
tttttgaggacggcc

SEQ ID NO: 73221 - DNA, 15 bp, Artificial Sequence
  dgRNA
  Cmtm2b
gtgaatgctgatgca

SEQ ID NO: 73222 - DNA, 15 bp, Artificial Sequence
  dgRNA
  Cmtm2b
attccgcagtcccag

SEQ ID NO: 73223 - DNA, 15 bp, Artificial Sequence
  dgRNA
  Cmtm2b
aggccgtcctcaaaa

SEQ ID NO: 73224 - DNA, 15 bp, Artificial Sequence
  dgRNA
  Vmn1r82
ttatttttcgggtgc

SEQ ID NO: 73225 - DNA, 15 bp, Artificial Sequence
  dgRNA
  Vmn1r82
tcctagggccttact

SEQ ID NO: 73226 - DNA, 15 bp, Artificial Sequence
  dgRNA
  Vmn1r82
ctaatcagatctagg

SEQ ID NO: 73227 - DNA, 15 bp, Artificial Sequence
  dgRNA
  9530068E07Rik
cccacgctaaccttt

SEQ ID NO: 73228 - DNA, 15 bp, Artificial Sequence
  dgRNA
  9530068E07Rik
ccacgctaacctttc

SEQ ID NO: 73229 - DNA, 15 bp, Artificial Sequence
  dgRNA
  9530068E07Rik
gcaacgtcatcacgc

SEQ ID NO: 73230 - DNA, 15 bp, Artificial Sequence
  dgRNA
  9530068E07Rik
caacgtcatcacgcc

SEQ ID NO: 73231 - DNA, 15 bp, Artificial Sequence
  dgRNA
  Mgat4a
attattcagtgtcaa

SEQ ID NO: 73232 - DNA, 15 bp, Artificial Sequence
  dgRNA
  Gm6592
tagactctatcaaca

SEQ ID NO: 73233 - DNA, 15 bp, Artificial Sequence
  dgRNA
  Spa17
cactatcccaaacac

SEQ ID NO: 73234 - DNA, 15 bp, Artificial Sequence
  dgRNA
  Spa17
caaacacaggccccg

SEQ ID NO: 73235 - DNA, 15 bp, Artificial Sequence
  dgRNA
  Spa17
taacccgccgaattc

SEQ ID NO: 73236 - DNA, 15 bp, Artificial Sequence
  dgRNA
  Spa17
ggaagagcccctatg

SEQ ID NO: 73237 - DNA, 15 bp, Artificial Sequence
  dgRNA
  Veph1
tgggttattcattaa

SEQ ID NO: 73238 - DNA, 15 bp, Artificial Sequence
  dgRNA
  Veph1
cggaacctaaattac

SEQ ID NO: 73239 - DNA, 15 bp, Artificial Sequence
  dgRNA
  Veph1
acctaaattactggt

SEQ ID NO: 73240 - DNA, 15 bp, Artificial Sequence
  dgRNA
  Veph1
gctgtaagtctacag

SEQ ID NO: 73241 - DNA, 15 bp, Artificial Sequence
  dgRNA
  Ube2z
acctttaaccatgga

SEQ ID NO: 73242 - DNA, 15 bp, Artificial Sequence
  dgRNA
  Ube2z
gcgcagaatctgcgc

SEQ ID NO: 73243 - DNA, 15 bp, Artificial Sequence
  dgRNA
  Ube2z
gaatctgcgctggcc

SEQ ID NO: 73244 - DNA, 15 bp, Artificial Sequence
  dgRNA
  Ube2z
cgccccccgctctgg

SEQ ID NO: 73245 - DNA, 15 bp, Artificial Sequence
  dgRNA
  Uxs1
attacactgcgcttg

SEQ ID NO: 73246 - DNA, 15 bp, Artificial Sequence
  dgRNA
  Uxs1
ttacactgcgcttgc

SEQ ID NO: 73247 - DNA, 15 bp, Artificial Sequence
  dgRNA
  Uxs1
tacactgcgcttgcg

SEQ ID NO: 73248 - DNA, 15 bp, Artificial Sequence
  dgRNA
  Uxs1
gcgcttgcggggaaa

SEQ ID NO: 73249 - DNA, 15 bp, Artificial Sequence
  dgRNA
  Mrc2
acacgcactcccttg

SEQ ID NO: 73250 - DNA, 15 bp, Artificial Sequence
  dgRNA
  Mrc2
gcactcccttgcggc

SEQ ID NO: 73251 - DNA, 15 bp, Artificial Sequence
  dgRNA
  Mrc2
cactcccttgcggcc

SEQ ID NO: 73252 - DNA, 15 bp, Artificial Sequence
  dgRNA
  Mrc2
cgccctccctctgcg

SEQ ID NO: 73253 - DNA, 15 bp, Artificial Sequence
  dgRNA
  Dlx4
gtgccagaaaaggcg

SEQ ID NO: 73254 - DNA, 15 bp, Artificial Sequence
  dgRNA
  Dlx4
ggcggggctcggtac

SEQ ID NO: 73255 - DNA, 15 bp, Artificial Sequence
  dgRNA
  Dlx4
gtgtcgcaactaaac

SEQ ID NO: 73256 - DNA, 15 bp, Artificial Sequence
  dgRNA
  Dlx4
tgtcgcaactaaacc

SEQ ID NO: 73257 - DNA, 15 bp, Artificial Sequence
  dgRNA
  Npas2
agaggccaccgcgct

SEQ ID NO: 73258 - DNA, 15 bp, Artificial Sequence
  dgRNA
  Npas2
gaggccaccgcgctt

SEQ ID NO: 73259 - DNA, 15 bp, Artificial Sequence
  dgRNA
  Npas2
aggccaccgcgcttg

SEQ ID NO: 73260 - DNA, 15 bp, Artificial Sequence
  dgRNA
  Npas2
ggggacgcacgatct

SEQ ID NO: 73261 - DNA, 15 bp, Artificial Sequence
  dgRNA
  Psmc3ip
tggcggcttatagaa

SEQ ID NO: 73262 - DNA, 15 bp, Artificial Sequence
  dgRNA
  Psmc3ip
aggaccgctcaccac

SEQ ID NO: 73263 - DNA, 15 bp, Artificial Sequence
  dgRNA
  Psmc3ip
cactgcgggcccagg

SEQ ID NO: 73264 - DNA, 15 bp, Artificial Sequence
  dgRNA
  Psmc3ip
gctgacctgtcacta

SEQ ID NO: 73265 - DNA, 15 bp, Artificial Sequence
  dgRNA
  1700007K09Rik
gcttttagatgagca

SEQ ID NO: 73266 - DNA, 15 bp, Artificial Sequence
  dgRNA
  1700007K09Rik
cttgcccaaacacat

SEQ ID NO: 73267 - DNA, 15 bp, Artificial Sequence
  dgRNA
  Lgals8
aacacccttgagatc

SEQ ID NO: 73268 - DNA, 15 bp, Artificial Sequence
  dgRNA
  Lgals8
ggccggggtactcct

SEQ ID NO: 73269 - DNA, 15 bp, Artificial Sequence
  dgRNA
  Lgals8
tggccggggtactcc

SEQ ID NO: 73270 - DNA, 15 bp, Artificial Sequence
  dgRNA
  Lgals8
aagaataatcgtggg

SEQ ID NO: 73271 - DNA, 15 bp, Artificial Sequence
  dgRNA
  Sparcl1
agtcacaagccccaa

SEQ ID NO: 73272 - DNA, 15 bp, Artificial Sequence
  dgRNA
  Sparcl1
agttaggagcctatg

SEQ ID NO: 73273 - DNA, 15 bp, Artificial Sequence
  dgRNA
  Sparcl1
gcgactgcaaagcca

SEQ ID NO: 73274 - DNA, 15 bp, Artificial Sequence
  dgRNA
  Sparcl1
gattgggatcccttg

SEQ ID NO: 73275 - DNA, 15 bp, Artificial Sequence
  dgRNA
  Rrn3
gcttcaggccggtta

SEQ ID NO: 73276 - DNA, 15 bp, Artificial Sequence
  dgRNA
  Rrn3
tacgctctgctcacg

SEQ ID NO: 73277 - DNA, 15 bp, Artificial Sequence
  dgRNA
  Rrn3
acgctctgctcacgt

SEQ ID NO: 73278 - DNA, 15 bp, Artificial Sequence
  dgRNA
  Rrn3
gggccgcgtcccgca

SEQ ID NO: 73279 - DNA, 15 bp, Artificial Sequence
  dgRNA
  Plcd4
cctttcagacactag

SEQ ID NO: 73280 - DNA, 15 bp, Artificial Sequence
  dgRNA
  Plcd4
ctttcagacactagc

SEQ ID NO: 73281 - DNA, 15 bp, Artificial Sequence
  dgRNA
  Plcd4
cggatgcaggtgcag

SEQ ID NO: 73282 - DNA, 15 bp, Artificial Sequence
  dgRNA
  Plcd4
ccgctagtgtctgaa

SEQ ID NO: 73283 - DNA, 15 bp, Artificial Sequence
  dgRNA
  Tmem260
actcctaagccgtgc

SEQ ID NO: 73284 - DNA, 15 bp, Artificial Sequence
  dgRNA
  Tmem260
tcctccccgacctgg

SEQ ID NO: 73285 - DNA, 15 bp, Artificial Sequence
  dgRNA
  Tmem260
cgacctggcgggcga

SEQ ID NO: 73286 - DNA, 15 bp, Artificial Sequence
  dgRNA
  Tmem260
tggcgggcgaaggta

SEQ ID NO: 73287 - DNA, 15 bp, Artificial Sequence
  dgRNA
  Pitx2
acgacactccgcaca

SEQ ID NO: 73288 - DNA, 15 bp, Artificial Sequence
  dgRNA
  Pitx2
ctccgcacacggagt

SEQ ID NO: 73289 - DNA, 15 bp, Artificial Sequence
  dgRNA
  Pitx2
cacacggagtcggag

SEQ ID NO: 73290 - DNA, 15 bp, Artificial Sequence
  dgRNA
  Pitx2
acggagtcggagcgg

SEQ ID NO: 73291 - DNA, 15 bp, Artificial Sequence
  dgRNA
  Irak1
cccccgtgtggcgga

SEQ ID NO: 73292 - DNA, 15 bp, Artificial Sequence
  dgRNA
  Irak1
gccttccgccacacg

SEQ ID NO: 73293 - DNA, 15 bp, Artificial Sequence
  dgRNA
  Pik3r1
gcagcgaggggtgcg

SEQ ID NO: 73294 - DNA, 15 bp, Artificial Sequence
  dgRNA
  Pik3r1
gtagctcctagacct

SEQ ID NO: 73295 - DNA, 15 bp, Artificial Sequence
  dgRNA
  Pik3r1
ccttggtagccctcc

SEQ ID NO: 73296 - DNA, 15 bp, Artificial Sequence
  dgRNA
  Pik3r1
agccctcccggagac

SEQ ID NO: 73297 - DNA, 15 bp, Artificial Sequence
  dgRNA
  Kif1a
cacgtggtcactggg

SEQ ID NO: 73298 - DNA, 15 bp, Artificial Sequence
  dgRNA
  Kif1a
acgtggtcactgggg

SEQ ID NO: 73299 - DNA, 15 bp, Artificial Sequence
  dgRNA
  Kif1a
cccccagtgaccacg

SEQ ID NO: 73300 - DNA, 15 bp, Artificial Sequence
  dgRNA
  Kif1a
gagcaatgttcaaag

SEQ ID NO: 73301 - DNA, 15 bp, Artificial Sequence
  dgRNA
  Chrna6
ttatccttgaggaat

SEQ ID NO: 73302 - DNA, 15 bp, Artificial Sequence
  dgRNA
  Chrna6
tatccttgaggaata

SEQ ID NO: 73303 - DNA, 15 bp, Artificial Sequence
  dgRNA
  Chrna6
tccttgaggaatagg

SEQ ID NO: 73304 - DNA, 15 bp, Artificial Sequence
  dgRNA
  Chrna6
ccttgaggaataggg

SEQ ID NO: 73305 - DNA, 15 bp, Artificial Sequence
  dgRNA
  Slc10a7
atgaggctgggcgtc

SEQ ID NO: 73306 - DNA, 15 bp, Artificial Sequence
  dgRNA
  Slc10a7
tgaggctgggcgtct

SEQ ID NO: 73307 - DNA, 15 bp, Artificial Sequence
  dgRNA
  Slc10a7
gggcctccccaagct

SEQ ID NO: 73308 - DNA, 15 bp, Artificial Sequence
  dgRNA
  Slc10a7
gccgtgtatgcacgg

SEQ ID NO: 73309 - DNA, 15 bp, Artificial Sequence
  dgRNA
  Arhgef7
gtcgtgcgccggggc

SEQ ID NO: 73310 - DNA, 15 bp, Artificial Sequence
  dgRNA
  Arhgef7
cgccggggctggcgc

SEQ ID NO: 73311 - DNA, 15 bp, Artificial Sequence
  dgRNA
  Arhgef7
ctccggtgatgtcat

SEQ ID NO: 73312 - DNA, 15 bp, Artificial Sequence
  dgRNA
  Arhgef7
tccggtgatgtcatc

SEQ ID NO: 73313 - DNA, 15 bp, Artificial Sequence
  dgRNA
  Pcnxl4
agtgcggaagaagtc

SEQ ID NO: 73314 - DNA, 15 bp, Artificial Sequence
  dgRNA
  Pcnxl4
gtgcggaagaagtct

SEQ ID NO: 73315 - DNA, 15 bp, Artificial Sequence
  dgRNA
  Pcnxl4
caacactagcccgcc

SEQ ID NO: 73316 - DNA, 15 bp, Artificial Sequence
  dgRNA
  Pcnxl4
ccgcccggccctgcg

SEQ ID NO: 73317 - DNA, 15 bp, Artificial Sequence
  dgRNA
  Apeh
tccgccctcactcct

SEQ ID NO: 73318 - DNA, 15 bp, Artificial Sequence
  dgRNA
  Apeh
gggcggctccttcgt

SEQ ID NO: 73319 - DNA, 15 bp, Artificial Sequence
  dgRNA
  Apeh
ccggtgttcagagac

SEQ ID NO: 73320 - DNA, 15 bp, Artificial Sequence
  dgRNA
  Apeh
ggctccgaggagtga

SEQ ID NO: 73321 - DNA, 15 bp, Artificial Sequence
  dgRNA
  Tbc1d1
tgtgactcgccagtc

SEQ ID NO: 73322 - DNA, 15 bp, Artificial Sequence
  dgRNA
  Tbc1d1
ctagccagagtcgct

SEQ ID NO: 73323 - DNA, 15 bp, Artificial Sequence
  dgRNA
  Tbc1d1
cagagtcgcttggtg

SEQ ID NO: 73324 - DNA, 15 bp, Artificial Sequence
  dgRNA
  Tbc1d1
agtcgcttggtgcgg

SEQ ID NO: 73325 - DNA, 15 bp, Artificial Sequence
  dgRNA
  Pramef12
attgacccttaagtc

SEQ ID NO: 73326 - DNA, 15 bp, Artificial Sequence
  dgRNA
  Pramef12
ccagccgcattttta

SEQ ID NO: 73327 - DNA, 15 bp, Artificial Sequence
  dgRNA
  Pramef12
catttttacggaatg

SEQ ID NO: 73328 - DNA, 15 bp, Artificial Sequence
  dgRNA
  Pramef12
atttttacggaatga

SEQ ID NO: 73329 - DNA, 15 bp, Artificial Sequence
  dgRNA
  Spata6
cctcccaccacaatc

SEQ ID NO: 73330 - DNA, 15 bp, Artificial Sequence
  dgRNA
  Spata6
ttgctccgtagtgtc

SEQ ID NO: 73331 - DNA, 15 bp, Artificial Sequence
  dgRNA
  Spata6
cgtagtgtccggcct

SEQ ID NO: 73332 - DNA, 15 bp, Artificial Sequence
  dgRNA
  Spata6
tgtccggccttggcg

SEQ ID NO: 73333 - DNA, 15 bp, Artificial Sequence
  dgRNA
  Tmprss5
atcctctacaacaag

SEQ ID NO: 73334 - DNA, 15 bp, Artificial Sequence
  dgRNA
  Tmprss5
tcctctacaacaagg

SEQ ID NO: 73335 - DNA, 15 bp, Artificial Sequence
  dgRNA
  Tmprss5
aagggggcctattca

SEQ ID NO: 73336 - DNA, 15 bp, Artificial Sequence
  dgRNA
  Tmprss5
agggggcctattcat

SEQ ID NO: 73337 - DNA, 15 bp, Artificial Sequence
  dgRNA
  Tjp1
acaggatggatcgcg

SEQ ID NO: 73338 - DNA, 15 bp, Artificial Sequence
  dgRNA
  Tjp1
tggatcgcgcggcag

SEQ ID NO: 73339 - DNA, 15 bp, Artificial Sequence
  dgRNA
  Tjp1
gcctagcaagtaact

SEQ ID NO: 73340 - DNA, 15 bp, Artificial Sequence
  dgRNA
  Tjp1
cctagcaagtaactt

SEQ ID NO: 73341 - DNA, 15 bp, Artificial Sequence
  dgRNA
  Prl7b1
atcatgaagtcaact

SEQ ID NO: 73342 - DNA, 15 bp, Artificial Sequence
  dgRNA
  Prl7b1
gatattatctgatgc

SEQ ID NO: 73343 - DNA, 15 bp, Artificial Sequence
  dgRNA
  Prl7b1
gcagtaagtggcctg

SEQ ID NO: 73344 - DNA, 15 bp, Artificial Sequence
  dgRNA
  Prl7b1
gctaaagtatatatg

SEQ ID NO: 73345 - DNA, 15 bp, Artificial Sequence
  dgRNA
  Olfr222
gaagtttagcaagac

SEQ ID NO: 73346 - DNA, 15 bp, Artificial Sequence
  dgRNA
  Olfr222
cttgacgccccatcc

SEQ ID NO: 73347 - DNA, 15 bp, Artificial Sequence
  dgRNA
  Olfr222
ttgacgccccatcca

SEQ ID NO: 73348 - DNA, 15 bp, Artificial Sequence
  dgRNA
  Olfr222
tgacgccccatccag

SEQ ID NO: 73349 - DNA, 15 bp, Artificial Sequence
  dgRNA
  Muc5b
acacgtggctgtgca

SEQ ID NO: 73350 - DNA, 15 bp, Artificial Sequence
  dgRNA
  Muc5b
agaccgtgccttaca

SEQ ID NO: 73351 - DNA, 15 bp, Artificial Sequence
  dgRNA
  Muc5b
gtgccttacatggcc

SEQ ID NO: 73352 - DNA, 15 bp, Artificial Sequence
  dgRNA
  Muc5b
taagtccaggccccc

SEQ ID NO: 73353 - DNA, 15 bp, Artificial Sequence
  dgRNA
  Alox5
gaaggatgcgttgga

SEQ ID NO: 73354 - DNA, 15 bp, Artificial Sequence
  dgRNA
  Alox5
ggatgcgttggaagg

SEQ ID NO: 73355 - DNA, 15 bp, Artificial Sequence
  dgRNA
  Alox5
atgcgttggaaggtg

SEQ ID NO: 73356 - DNA, 15 bp, Artificial Sequence
  dgRNA
  Alox5
ggagccagcgcctga

SEQ ID NO: 73357 - DNA, 15 bp, Artificial Sequence
  dgRNA
  Olfr1424
aacttgatcaatttc

SEQ ID NO: 73358 - DNA, 15 bp, Artificial Sequence
  dgRNA
  Olfr1424
actacagccataatg

SEQ ID NO: 73359 - DNA, 15 bp, Artificial Sequence
  dgRNA
  Olfr1424
cttcataagctctta

SEQ ID NO: 73360 - DNA, 15 bp, Artificial Sequence
  dgRNA
  Olfr574
aggcactagcaaaaa

SEQ ID NO: 73361 - DNA, 15 bp, Artificial Sequence
  dgRNA
  Olfr574
ccctttgtattatag

SEQ ID NO: 73362 - DNA, 15 bp, Artificial Sequence
  dgRNA
  Olfr574
cctctataatacaaa

SEQ ID NO: 73363 - DNA, 15 bp, Artificial Sequence
  dgRNA
  Cnot6l
cgccctccgccgcct

SEQ ID NO: 73364 - DNA, 15 bp, Artificial Sequence
  dgRNA
  Cnot6l
cctccgccgcctcgg

SEQ ID NO: 73365 - DNA, 15 bp, Artificial Sequence
  dgRNA
  Cnot6l
cctcggtggttcctc

SEQ ID NO: 73366 - DNA, 15 bp, Artificial Sequence
  dgRNA
  Cnot6l
gttcctcaggcggcc

SEQ ID NO: 73367 - DNA, 15 bp, Artificial Sequence
  dgRNA
  Foxi2
agacctaagtaccct

SEQ ID NO: 73368 - DNA, 15 bp, Artificial Sequence
  dgRNA
  Foxi2
ccaagactgtttgtc

SEQ ID NO: 73369 - DNA, 15 bp, Artificial Sequence
  dgRNA
  Foxi2
ggagactcaccacct

SEQ ID NO: 73370 - DNA, 15 bp, Artificial Sequence
  dgRNA
  Foxi2
cccaatggcatttaa

SEQ ID NO: 73371 - DNA, 15 bp, Artificial Sequence
  dgRNA
  Ubl5
caggcgttgcaaaca

SEQ ID NO: 73372 - DNA, 15 bp, Artificial Sequence
  dgRNA
  Ubl5
aaaagcgccgccgag

SEQ ID NO: 73373 - DNA, 15 bp, Artificial Sequence
  dgRNA
  Ubl5
gcgccgccgagtgga

SEQ ID NO: 73374 - DNA, 15 bp, Artificial Sequence
  dgRNA
  Ubl5
cgccgccgagtggaa

SEQ ID NO: 73375 - DNA, 15 bp, Artificial Sequence
  dgRNA
  Vipr2
acaagggaagtaccc

SEQ ID NO: 73376 - DNA, 15 bp, Artificial Sequence
  dgRNA
  Vipr2
gtcggggtgaggccc

SEQ ID NO: 73377 - DNA, 15 bp, Artificial Sequence
  dgRNA
  Vipr2
tcggggtgaggccca

SEQ ID NO: 73378 - DNA, 15 bp, Artificial Sequence
  dgRNA
  Vipr2
ggtcttgcacttcag

SEQ ID NO: 73379 - DNA, 15 bp, Artificial Sequence
  dgRNA
  Cma1
acctatctgagtatc

SEQ ID NO: 73380 - DNA, 15 bp, Artificial Sequence
  dgRNA
  Cma1
cctatctgagtatct

SEQ ID NO: 73381 - DNA, 15 bp, Artificial Sequence
  dgRNA
  Cma1
acagtggtattcccg

SEQ ID NO: 73382 - DNA, 15 bp, Artificial Sequence
  dgRNA
  Cma1
gatccctagaatctt

SEQ ID NO: 73383 - DNA, 15 bp, Artificial Sequence
  dgRNA
  Ndufa12
gtagaacgacctccg

SEQ ID NO: 73384 - DNA, 15 bp, Artificial Sequence
  dgRNA
  Ndufa12
aacgacctccgcggc

SEQ ID NO: 73385 - DNA, 15 bp, Artificial Sequence
  dgRNA
  Ndufa12
ggccggttgacgagc

SEQ ID NO: 73386 - DNA, 15 bp, Artificial Sequence
  dgRNA
  Ndufa12
ggaacctccaaacgg

SEQ ID NO: 73387 - DNA, 15 bp, Artificial Sequence
  dgRNA
  Scn8a
ctgaccgctctcccg

SEQ ID NO: 73388 - DNA, 15 bp, Artificial Sequence
  dgRNA
  Scn8a
cgaggaccattacaa

SEQ ID NO: 73389 - DNA, 15 bp, Artificial Sequence
  dgRNA
  Scn8a
tgaagcgtgcggaag

SEQ ID NO: 73390 - DNA, 15 bp, Artificial Sequence
  dgRNA
  Scn8a
gaagtggaagccgtg

SEQ ID NO: 73391 - DNA, 15 bp, Artificial Sequence
  dgRNA
  Ifi35
ggtttatgctagaac

SEQ ID NO: 73392 - DNA, 15 bp, Artificial Sequence
  dgRNA
  Ifi35
tccctttgcggtccc

SEQ ID NO: 73393 - DNA, 15 bp, Artificial Sequence
  dgRNA
  Ifi35
agcacatgcctgact

SEQ ID NO: 73394 - DNA, 15 bp, Artificial Sequence
  dgRNA
  Ifi35
gaaggctccgcccaa

SEQ ID NO: 73395 - DNA, 15 bp, Artificial Sequence
  dgRNA
  Ahdc1
tcctaacccttgagg

SEQ ID NO: 73396 - DNA, 15 bp, Artificial Sequence
  dgRNA
  Ahdc1
agtcctagataaaac

SEQ ID NO: 73397 - DNA, 15 bp, Artificial Sequence
  dgRNA
  Ahdc1
aaaacgggattcatc

SEQ ID NO: 73398 - DNA, 15 bp, Artificial Sequence
  dgRNA
  Ahdc1
aaacgggattcatcc

SEQ ID NO: 73399 - DNA, 15 bp, Artificial Sequence
  dgRNA
  Fam13c
gtagagcgagcgtgc

SEQ ID NO: 73400 - DNA, 15 bp, Artificial Sequence
  dgRNA
  Fam13c
tagagcgagcgtgcc

SEQ ID NO: 73401 - DNA, 15 bp, Artificial Sequence
  dgRNA
  Fam13c
cgctcgctctacctt

SEQ ID NO: 73402 - DNA, 15 bp, Artificial Sequence
  dgRNA
  Fam13c
acgctcgctctacct

SEQ ID NO: 73403 - DNA, 15 bp, Artificial Sequence
  dgRNA
  Meis3
ggagaggggccgctc

SEQ ID NO: 73404 - DNA, 15 bp, Artificial Sequence
  dgRNA
  Meis3
gaggggccgctcggg

SEQ ID NO: 73405 - DNA, 15 bp, Artificial Sequence
  dgRNA
  Meis3
gggccgctcgggagg

SEQ ID NO: 73406 - DNA, 15 bp, Artificial Sequence
  dgRNA
  Meis3
cgctccggcagacag

SEQ ID NO: 73407 - DNA, 15 bp, Artificial Sequence
  dgRNA
  Rab23
gccgggatgtcgctg

SEQ ID NO: 73408 - DNA, 15 bp, Artificial Sequence
  dgRNA
  Rab23
ccgggatgtcgctgt

SEQ ID NO: 73409 - DNA, 15 bp, Artificial Sequence
  dgRNA
  Rab23
cgctgtgggcgcgga

SEQ ID NO: 73410 - DNA, 15 bp, Artificial Sequence
  dgRNA
  Rab23
tgtgggcgcggacgg

SEQ ID NO: 73411 - DNA, 15 bp, Artificial Sequence
  dgRNA
  Ndufa1
cgtcgtcacactccg

SEQ ID NO: 73412 - DNA, 15 bp, Artificial Sequence
  dgRNA
  Ndufa1
cgtcacactccgtgg

SEQ ID NO: 73413 - DNA, 15 bp, Artificial Sequence
  dgRNA
  Ndufa1
tgcagcggatcagat

SEQ ID NO: 73414 - DNA, 15 bp, Artificial Sequence
  dgRNA
  Ndufa1
agcggatcagatagg

SEQ ID NO: 73415 - DNA, 15 bp, Artificial Sequence
  dgRNA
  Fam83g
gctcttactccggac

SEQ ID NO: 73416 - DNA, 15 bp, Artificial Sequence
  dgRNA
  Fam83g
ctcttactccggact

SEQ ID NO: 73417 - DNA, 15 bp, Artificial Sequence
  dgRNA
  Fam83g
tcttactccggactg

SEQ ID NO: 73418 - DNA, 15 bp, Artificial Sequence
  dgRNA
  Fam83g
ctccggactggggcg

SEQ ID NO: 73419 - DNA, 15 bp, Artificial Sequence
  dgRNA
  Skp1a
acctctgcggcgctc

SEQ ID NO: 73420 - DNA, 15 bp, Artificial Sequence
  dgRNA
  Skp1a
cctctgcggcgctca

SEQ ID NO: 73421 - DNA, 15 bp, Artificial Sequence
  dgRNA
  Skp1a
gtttcgactgccgtc

SEQ ID NO: 73422 - DNA, 15 bp, Artificial Sequence
  dgRNA
  Skp1a
gtcaggcgatctcaa

SEQ ID NO: 73423 - DNA, 15 bp, Artificial Sequence
  dgRNA
  Sco2
agccccacgcaacgc

SEQ ID NO: 73424 - DNA, 15 bp, Artificial Sequence
  dgRNA
  Sco2
acgcccgagagcaag

SEQ ID NO: 73425 - DNA, 15 bp, Artificial Sequence
  dgRNA
  Sco2
aggagctgctcgcac

SEQ ID NO: 73426 - DNA, 15 bp, Artificial Sequence
  dgRNA
  Sco2
gctcgcaccggcaga

SEQ ID NO: 73427 - DNA, 15 bp, Artificial Sequence
  dgRNA
  Eef1a2
aggtggaacacaata

SEQ ID NO: 73428 - DNA, 15 bp, Artificial Sequence
  dgRNA
  Eef1a2
agcgcgcagaggtgg

SEQ ID NO: 73429 - DNA, 15 bp, Artificial Sequence
  dgRNA
  Eef1a2
cagcgcgcagaggtg

SEQ ID NO: 73430 - DNA, 15 bp, Artificial Sequence
  dgRNA
  Eef1a2
gcagcgcgcagaggt

SEQ ID NO: 73431 - DNA, 15 bp, Artificial Sequence
  dgRNA
  Olfr1048
ctatgcttaagttgt

SEQ ID NO: 73432 - DNA, 15 bp, Artificial Sequence
  dgRNA
  Olfr1048
atttaatcaactaac

SEQ ID NO: 73433 - DNA, 15 bp, Artificial Sequence
  dgRNA
  Wnt9b
agtgggcgcggctcc

SEQ ID NO: 73434 - DNA, 15 bp, Artificial Sequence
  dgRNA
  Wnt9b
gcgggcagagttcgg

SEQ ID NO: 73435 - DNA, 15 bp, Artificial Sequence
  dgRNA
  Wnt9b
gttcggcggagccta

SEQ ID NO: 73436 - DNA, 15 bp, Artificial Sequence
  dgRNA
  Wnt9b
ttcggcggagcctat

SEQ ID NO: 73437 - DNA, 15 bp, Artificial Sequence
  dgRNA
  Tacc2
cccagcagtttccgg

SEQ ID NO: 73438 - DNA, 15 bp, Artificial Sequence
  dgRNA
  Tacc2
gtttccggaggatgt

SEQ ID NO: 73439 - DNA, 15 bp, Artificial Sequence
  dgRNA
  Tacc2
gaagatgcaggcgtc

SEQ ID NO: 73440 - DNA, 15 bp, Artificial Sequence
  dgRNA
  Tacc2
aggcgtcaggccgct

SEQ ID NO: 73441 - DNA, 15 bp, Artificial Sequence
  dgRNA
  Itsn1
agttaggcgggagtg

SEQ ID NO: 73442 - DNA, 15 bp, Artificial Sequence
  dgRNA
  Itsn1
gttaggcgggagtga

SEQ ID NO: 73443 - DNA, 15 bp, Artificial Sequence
  dgRNA
  Filip1
cttaaaagggtctgc

SEQ ID NO: 73444 - DNA, 15 bp, Artificial Sequence
  dgRNA
  Filip1
gtctgccggcttccc

SEQ ID NO: 73445 - DNA, 15 bp, Artificial Sequence
  dgRNA
  Filip1
tctgccggcttcccc

SEQ ID NO: 73446 - DNA, 15 bp, Artificial Sequence
  dgRNA
  Filip1
ccccgggatctttgc

SEQ ID NO: 73447 - DNA, 15 bp, Artificial Sequence
  dgRNA
  Dnajb6
ttcagcactgcgagt

SEQ ID NO: 73448 - DNA, 15 bp, Artificial Sequence
  dgRNA
  Dnajb6
cggttcactctaagt

SEQ ID NO: 73449 - DNA, 15 bp, Artificial Sequence
  dgRNA
  Dnajb6
ggttcactctaagtc

SEQ ID NO: 73450 - DNA, 15 bp, Artificial Sequence
  dgRNA
  Dnajb6
gtcgggcctgcttgt

SEQ ID NO: 73451 - DNA, 15 bp, Artificial Sequence
  dgRNA
  Zfyve1
ccgctcctccctagc

SEQ ID NO: 73452 - DNA, 15 bp, Artificial Sequence
  dgRNA
  Zfyve1
cgctcctccctagct

SEQ ID NO: 73453 - DNA, 15 bp, Artificial Sequence
  dgRNA
  Zfyve1
cgcttgcggcctttt

SEQ ID NO: 73454 - DNA, 15 bp, Artificial Sequence
  dgRNA
  Zfyve1
gcgcttgcggccttt

SEQ ID NO: 73455 - DNA, 15 bp, Artificial Sequence
  dgRNA
  4930444G20Rik
cgcttggtactatac

SEQ ID NO: 73456 - DNA, 15 bp, Artificial Sequence
  dgRNA
  Pcdh9
caattgtgttgacag

SEQ ID NO: 73457 - DNA, 15 bp, Artificial Sequence
  dgRNA
  Pcdh9
gcatcactcctcagt

SEQ ID NO: 73458 - DNA, 15 bp, Artificial Sequence
  dgRNA
  Pcdh9
gaagtgtgcatggac

SEQ ID NO: 73459 - DNA, 15 bp, Artificial Sequence
  dgRNA
  Pcdh9
tgcacgaactgcaag

SEQ ID NO: 73460 - DNA, 15 bp, Artificial Sequence
  dgRNA
  Pard3
gccgagacgccgaac

SEQ ID NO: 73461 - DNA, 15 bp, Artificial Sequence
  dgRNA
  Pard3
gagacgccgaacagg

SEQ ID NO: 73462 - DNA, 15 bp, Artificial Sequence
  dgRNA
  Pard3
cgccgaacaggtggc

SEQ ID NO: 73463 - DNA, 15 bp, Artificial Sequence
  dgRNA
  Pard3
cgaacaggtggccgg

SEQ ID NO: 73464 - DNA, 15 bp, Artificial Sequence
  dgRNA
  Zfp119a
gcctgagcggacacc

SEQ ID NO: 73465 - DNA, 15 bp, Artificial Sequence
  dgRNA
  Zfp119a
agcggacaccaggac

SEQ ID NO: 73466 - DNA, 15 bp, Artificial Sequence
  dgRNA
  Zfp119a
gcggacaccaggact

SEQ ID NO: 73467 - DNA, 15 bp, Artificial Sequence
  dgRNA
  Zfp119a
cagccctcggtgact

SEQ ID NO: 73468 - DNA, 15 bp, Artificial Sequence
  dgRNA
  Trappc2
ccgcgcttcctccca

SEQ ID NO: 73469 - DNA, 15 bp, Artificial Sequence
  dgRNA
  Trappc2
cttcctcccacggta

SEQ ID NO: 73470 - DNA, 15 bp, Artificial Sequence
  dgRNA
  Trappc2
ttcctcccacggtat

SEQ ID NO: 73471 - DNA, 15 bp, Artificial Sequence
  dgRNA
  Trappc2
tcccacggtatggga

SEQ ID NO: 73472 - DNA, 15 bp, Artificial Sequence
  dgRNA
  1700017N19Rik
aataatccacttagg

SEQ ID NO: 73473 - DNA, 15 bp, Artificial Sequence
  dgRNA
  1700017N19Rik
gattatgtaatagtg

SEQ ID NO: 73474 - DNA, 15 bp, Artificial Sequence
  dgRNA
  1700017N19Rik
gctactccacctaag

SEQ ID NO: 73475 - DNA, 15 bp, Artificial Sequence
  dgRNA
  1700017N19Rik
ctcatatgcaactgt

SEQ ID NO: 73476 - DNA, 15 bp, Artificial Sequence
  dgRNA
  Tssc1
agagcgccgccctga

SEQ ID NO: 73477 - DNA, 15 bp, Artificial Sequence
  dgRNA
  Tssc1
cgctgcttttgctcc

SEQ ID NO: 73478 - DNA, 15 bp, Artificial Sequence
  dgRNA
  Tssc1
cttttgctccgggcc

SEQ ID NO: 73479 - DNA, 15 bp, Artificial Sequence
  dgRNA
  Tssc1
ccggccttccaaccc

SEQ ID NO: 73480 - DNA, 15 bp, Artificial Sequence
  dgRNA
  Sstr3
cttgccacccccaac

SEQ ID NO: 73481 - DNA, 15 bp, Artificial Sequence
  dgRNA
  Sstr3
ttgccacccccaact

SEQ ID NO: 73482 - DNA, 15 bp, Artificial Sequence
  dgRNA
  Sstr3
cccccatcccgtgtc

SEQ ID NO: 73483 - DNA, 15 bp, Artificial Sequence
  dgRNA
  Sstr3
accctccacgtgtcc

SEQ ID NO: 73484 - DNA, 15 bp, Artificial Sequence
  dgRNA
  Ube2n
tccgccacccccggc

SEQ ID NO: 73485 - DNA, 15 bp, Artificial Sequence
  dgRNA
  Ube2n
cgccacccccggctg

SEQ ID NO: 73486 - DNA, 15 bp, Artificial Sequence
  dgRNA
  Ube2n
acccccggctggggt

SEQ ID NO: 73487 - DNA, 15 bp, Artificial Sequence
  dgRNA
  Ube2n
cccccggctggggtt

SEQ ID NO: 73488 - DNA, 15 bp, Artificial Sequence
  dgRNA
  Fgf18
cttccccgcaccggc

SEQ ID NO: 73489 - DNA, 15 bp, Artificial Sequence
  dgRNA
  Fgf18
ttccccgcaccggcc

SEQ ID NO: 73490 - DNA, 15 bp, Artificial Sequence
  dgRNA
  Fgf18
cccgcgccggctcgg

SEQ ID NO: 73491 - DNA, 15 bp, Artificial Sequence
  dgRNA
  Fgf18
ccgcgccggctcgga

SEQ ID NO: 73492 - DNA, 15 bp, Artificial Sequence
  dgRNA
  Cluap1
tctggcgcgcgagtc

SEQ ID NO: 73493 - DNA, 15 bp, Artificial Sequence
  dgRNA
  Cluap1
ctggcgcgcgagtct

SEQ ID NO: 73494 - DNA, 15 bp, Artificial Sequence
  dgRNA
  Cluap1
ctgggcgccaatttc

SEQ ID NO: 73495 - DNA, 15 bp, Artificial Sequence
  dgRNA
  Cluap1
caatttccggcttgt

SEQ ID NO: 73496 - DNA, 15 bp, Artificial Sequence
  dgRNA
  Lrif1
acttcccacggaagc

SEQ ID NO: 73497 - DNA, 15 bp, Artificial Sequence
  dgRNA
  Lrif1
tcccacggaagctgg

SEQ ID NO: 73498 - DNA, 15 bp, Artificial Sequence
  dgRNA
  Lrif1
agcttccgtgggaag

SEQ ID NO: 73499 - DNA, 15 bp, Artificial Sequence
  dgRNA
  Lrif1
tcccccagcttccgt

SEQ ID NO: 73500 - DNA, 15 bp, Artificial Sequence
  dgRNA
  Srpk3
ggggtgtttggctta

SEQ ID NO: 73501 - DNA, 15 bp, Artificial Sequence
  dgRNA
  Srpk3
gtttggcttaggggc

SEQ ID NO: 73502 - DNA, 15 bp, Artificial Sequence
  dgRNA
  Srpk3
ggaggctatttataa

SEQ ID NO: 73503 - DNA, 15 bp, Artificial Sequence
  dgRNA
  Srpk3
ggcgagtgagatcag

SEQ ID NO: 73504 - DNA, 15 bp, Artificial Sequence
  dgRNA
  Olfr1254
ggtgacatttatgag

SEQ ID NO: 73505 - DNA, 15 bp, Artificial Sequence
  dgRNA
  Olfr1254
cttgttcacaattaa

SEQ ID NO: 73506 - DNA, 15 bp, Artificial Sequence
  dgRNA
  Myt1l
gcagcccgcccgagc

SEQ ID NO: 73507 - DNA, 15 bp, Artificial Sequence
  dgRNA
  Myt1l
cagcccgcccgagca

SEQ ID NO: 73508 - DNA, 15 bp, Artificial Sequence
  dgRNA
  Myt1l
gcagggtaagtcagc

SEQ ID NO: 73509 - DNA, 15 bp, Artificial Sequence
  dgRNA
  Myt1l
caggatgctcccggt

SEQ ID NO: 73510 - DNA, 15 bp, Artificial Sequence
  dgRNA
  Cdc42ep4
gaaaatcatttgcgg

SEQ ID NO: 73511 - DNA, 15 bp, Artificial Sequence
  dgRNA
  Cdc42ep4
aatcatttgcggagg

SEQ ID NO: 73512 - DNA, 15 bp, Artificial Sequence
  dgRNA
  Cdc42ep4
atcatttgcggagga

SEQ ID NO: 73513 - DNA, 15 bp, Artificial Sequence
  dgRNA
  Cdc42ep4
tcatttgcggaggag

SEQ ID NO: 73514 - DNA, 15 bp, Artificial Sequence
  dgRNA
  Kcng2
gaggcctcccgccac

SEQ ID NO: 73515 - DNA, 15 bp, Artificial Sequence
  dgRNA
  Kcng2
aaatacccctgtcat

SEQ ID NO: 73516 - DNA, 15 bp, Artificial Sequence
  dgRNA
  Kcng2
aacttgtccgtagac

SEQ ID NO: 73517 - DNA, 15 bp, Artificial Sequence
  dgRNA
  Kcng2
gtcctggattaggcc

SEQ ID NO: 73518 - DNA, 15 bp, Artificial Sequence
  dgRNA
  1700019O17Rik
ctgtacccactactc

SEQ ID NO: 73519 - DNA, 15 bp, Artificial Sequence
  dgRNA
  1700019O17Rik
tatagtcagctcgcc

SEQ ID NO: 73520 - DNA, 15 bp, Artificial Sequence
  dgRNA
  1700019O17Rik
acaactgagcctagc

SEQ ID NO: 73521 - DNA, 15 bp, Artificial Sequence
  dgRNA
  1700019O17Rik
caactgagcctagca

SEQ ID NO: 73522 - DNA, 15 bp, Artificial Sequence
  dgRNA
  2300003K06Rik
taagccttaatccag

SEQ ID NO: 73523 - DNA, 15 bp, Artificial Sequence
  dgRNA
  2300003K06Rik
aagccttaatccaga

SEQ ID NO: 73524 - DNA, 15 bp, Artificial Sequence
  dgRNA
  2300003K06Rik
caatcatcatggttc

SEQ ID NO: 73525 - DNA, 15 bp, Artificial Sequence
  dgRNA
  2300003K06Rik
cgtttctacatttga

SEQ ID NO: 73526 - DNA, 15 bp, Artificial Sequence
  dgRNA
  Tpd52
gttttccgctcaagc

SEQ ID NO: 73527 - DNA, 15 bp, Artificial Sequence
  dgRNA
  Tpd52
ctcaagcaggtgcac

SEQ ID NO: 73528 - DNA, 15 bp, Artificial Sequence
  dgRNA
  Tpd52
gctagaccagaatcc

SEQ ID NO: 73529 - DNA, 15 bp, Artificial Sequence
  dgRNA
  Tpd52
ctagaccagaatcct

SEQ ID NO: 73530 - DNA, 15 bp, Artificial Sequence
  dgRNA
  Zbtb25
cacgccaagacgtgt

SEQ ID NO: 73531 - DNA, 15 bp, Artificial Sequence
  dgRNA
  Zbtb25
acgccaagacgtgtg

SEQ ID NO: 73532 - DNA, 15 bp, Artificial Sequence
  dgRNA
  Zbtb25
gcctccagtcacgac

SEQ ID NO: 73533 - DNA, 15 bp, Artificial Sequence
  dgRNA
  Zbtb25
cctccagtcacgact

SEQ ID NO: 73534 - DNA, 15 bp, Artificial Sequence
  dgRNA
  Ddit4
ttgcgaacgtgcgcc

SEQ ID NO: 73535 - DNA, 15 bp, Artificial Sequence
  dgRNA
  Ddit4
gcgcccggtgcctat

SEQ ID NO: 73536 - DNA, 15 bp, Artificial Sequence
  dgRNA
  Ddit4
ggtgcctattggctg

SEQ ID NO: 73537 - DNA, 15 bp, Artificial Sequence
  dgRNA
  Ddit4
gcctattggctgagg

SEQ ID NO: 73538 - DNA, 15 bp, Artificial Sequence
  dgRNA
  Chka
cccacaaccgccgcc

SEQ ID NO: 73539 - DNA, 15 bp, Artificial Sequence
  dgRNA
  Chka
caaccgccgcccggc

SEQ ID NO: 73540 - DNA, 15 bp, Artificial Sequence
  dgRNA
  Chka
gccggtcagtgaagc

SEQ ID NO: 73541 - DNA, 15 bp, Artificial Sequence
  dgRNA
  Chka
agccattccccgcgc

SEQ ID NO: 73542 - DNA, 15 bp, Artificial Sequence
  dgRNA
  Htra4
cctggtcagatctcg

SEQ ID NO: 73543 - DNA, 15 bp, Artificial Sequence
  dgRNA
  Htra4
cagatctcgtggccg

SEQ ID NO: 73544 - DNA, 15 bp, Artificial Sequence
  dgRNA
  Htra4
agatctcgtggccgt

SEQ ID NO: 73545 - DNA, 15 bp, Artificial Sequence
  dgRNA
  Htra4
tctcgtggccgtggg

SEQ ID NO: 73546 - DNA, 15 bp, Artificial Sequence
  dgRNA
  Pcdhb8
ggatttgtataacaa

SEQ ID NO: 73547 - DNA, 15 bp, Artificial Sequence
  dgRNA
  Pcdhb8
ccaggacgccattcc

SEQ ID NO: 73548 - DNA, 15 bp, Artificial Sequence
  dgRNA
  Pcdhb8
caggacgccattcct

SEQ ID NO: 73549 - DNA, 15 bp, Artificial Sequence
  dgRNA
  Pcdhb8
cgtcctgggcatcct

SEQ ID NO: 73550 - DNA, 15 bp, Artificial Sequence
  dgRNA
  Flt1
accgcacgcgcgctc

SEQ ID NO: 73551 - DNA, 15 bp, Artificial Sequence
  dgRNA
  Flt1
gcgcgctctggcccc

SEQ ID NO: 73552 - DNA, 15 bp, Artificial Sequence
  dgRNA
  Flt1
cgcgctctggccccc

SEQ ID NO: 73553 - DNA, 15 bp, Artificial Sequence
  dgRNA
  Flt1
gctacccgccctcgc

SEQ ID NO: 73554 - DNA, 15 bp, Artificial Sequence
  dgRNA
  Ctdsp2
gcacacaaacctacg

SEQ ID NO: 73555 - DNA, 15 bp, Artificial Sequence
  dgRNA
  Ctdsp2
cacacaaacctacga

SEQ ID NO: 73556 - DNA, 15 bp, Artificial Sequence
  dgRNA
  Ctdsp2
gtggttcttgccaga

SEQ ID NO: 73557 - DNA, 15 bp, Artificial Sequence
  dgRNA
  Ctdsp2
tggttcttgccagat

SEQ ID NO: 73558 - DNA, 15 bp, Artificial Sequence
  dgRNA
  Mmel1
gaccctgggtcgctt

SEQ ID NO: 73559 - DNA, 15 bp, Artificial Sequence
  dgRNA
  Mmel1
accctgggtcgcttt

SEQ ID NO: 73560 - DNA, 15 bp, Artificial Sequence
  dgRNA
  Mmel1
tagcctgaccctggt

SEQ ID NO: 73561 - DNA, 15 bp, Artificial Sequence
  dgRNA
  Mmel1
gcccaaagcgaccca

SEQ ID NO: 73562 - DNA, 15 bp, Artificial Sequence
  dgRNA
  Oit3
agcaaggcctctatc

SEQ ID NO: 73563 - DNA, 15 bp, Artificial Sequence
  dgRNA
  Oit3
ttccgctgtcccacg

SEQ ID NO: 73564 - DNA, 15 bp, Artificial Sequence
  dgRNA
  Oit3
gatacgggtctttag

SEQ ID NO: 73565 - DNA, 15 bp, Artificial Sequence
  dgRNA
  Oit3
gtattttactgatac

SEQ ID NO: 73566 - DNA, 15 bp, Artificial Sequence
  dgRNA
  Tyrp1
ctgcctagtagttaa

SEQ ID NO: 73567 - DNA, 15 bp, Artificial Sequence
  dgRNA
  Tyrp1
tagtagttaaagggc

SEQ ID NO: 73568 - DNA, 15 bp, Artificial Sequence
  dgRNA
  Tyrp1
tgccctttaactact

SEQ ID NO: 73569 - DNA, 15 bp, Artificial Sequence
  dgRNA
  Ifrd2
taactatgaaccgcg

SEQ ID NO: 73570 - DNA, 15 bp, Artificial Sequence
  dgRNA
  Ifrd2
aactatgaaccgcgc

SEQ ID NO: 73571 - DNA, 15 bp, Artificial Sequence
  dgRNA
  Ifrd2
tatgaaccgcgcggg

SEQ ID NO: 73572 - DNA, 15 bp, Artificial Sequence
  dgRNA
  Ifrd2
atgaaccgcgcgggc

SEQ ID NO: 73573 - DNA, 15 bp, Artificial Sequence
  dgRNA
  B3gnt4
aacacctctgcggag

SEQ ID NO: 73574 - DNA, 15 bp, Artificial Sequence
  dgRNA
  B3gnt4
ctcgtgcccagctct

SEQ ID NO: 73575 - DNA, 15 bp, Artificial Sequence
  dgRNA
  B3gnt4
agagacttaaatcat

SEQ ID NO: 73576 - DNA, 15 bp, Artificial Sequence
  dgRNA
  B3gnt4
cgcagaggtgtttcc

SEQ ID NO: 73577 - DNA, 15 bp, Artificial Sequence
  dgRNA
  Otp
cctcccggcaggcgc

SEQ ID NO: 73578 - DNA, 15 bp, Artificial Sequence
  dgRNA
  Otp
ccggcaggcgcaggc

SEQ ID NO: 73579 - DNA, 15 bp, Artificial Sequence
  dgRNA
  Otp
cgggcgggcggagtg

SEQ ID NO: 73580 - DNA, 15 bp, Artificial Sequence
  dgRNA
  Otp
ggcgctgacatttgc

SEQ ID NO: 73581 - DNA, 15 bp, Artificial Sequence
  dgRNA
  Tcp1
gtccttgagacaccg

SEQ ID NO: 73582 - DNA, 15 bp, Artificial Sequence
  dgRNA
  Abhd17c
ggcggcgcgctggag

SEQ ID NO: 73583 - DNA, 15 bp, Artificial Sequence
  dgRNA
  Abhd17c
gcggcgcgctggagc

SEQ ID NO: 73584 - DNA, 15 bp, Artificial Sequence
  dgRNA
  Abhd17c
cgctggagcgggcca

SEQ ID NO: 73585 - DNA, 15 bp, Artificial Sequence
  dgRNA
  Abhd17c
gccgcgcgcgagccc

SEQ ID NO: 73586 - DNA, 15 bp, Artificial Sequence
  dgRNA
  Mapk9
gtctgacggattctt

SEQ ID NO: 73587 - DNA, 15 bp, Artificial Sequence
  dgRNA
  Rara
tcagtgaagcccccc

SEQ ID NO: 73588 - DNA, 15 bp, Artificial Sequence
  dgRNA
  Rara
aaggcccagcccggg

SEQ ID NO: 73589 - DNA, 15 bp, Artificial Sequence
  dgRNA
  Rara
caaggcccagcccgg

SEQ ID NO: 73590 - DNA, 15 bp, Artificial Sequence
  dgRNA
  Rara
gcaaggcccagcccg

SEQ ID NO: 73591 - DNA, 15 bp, Artificial Sequence
  dgRNA
  Tbx18
agacgagccagatgg

SEQ ID NO: 73592 - DNA, 15 bp, Artificial Sequence
  dgRNA
  Tbx18
gatggcggcgctttt

SEQ ID NO: 73593 - DNA, 15 bp, Artificial Sequence
  dgRNA
  Tbx18
ttttccgaccttgta

SEQ ID NO: 73594 - DNA, 15 bp, Artificial Sequence
  dgRNA
  Tbx18
tgggcgcgggctgag

SEQ ID NO: 73595 - DNA, 15 bp, Artificial Sequence
  dgRNA
  Vmn1r71
cagttgtatacaatg

SEQ ID NO: 73596 - DNA, 15 bp, Artificial Sequence
  dgRNA
  Parp2
cctccgcccactttc

SEQ ID NO: 73597 - DNA, 15 bp, Artificial Sequence
  dgRNA
  Parp2
ccggccgccactata

SEQ ID NO: 73598 - DNA, 15 bp, Artificial Sequence
  dgRNA
  Parp2
tataaggctcgaaag

SEQ ID NO: 73599 - DNA, 15 bp, Artificial Sequence
  dgRNA
  Parp2
ataaatttttcgttt

SEQ ID NO: 73600 - DNA, 15 bp, Artificial Sequence
  dgRNA
  Cd19
gccaaaccatataga

SEQ ID NO: 73601 - DNA, 15 bp, Artificial Sequence
  dgRNA
  Cd19
acttgggctaagtgc

SEQ ID NO: 73602 - DNA, 15 bp, Artificial Sequence
  dgRNA
  Cd19
agtgcctgcaaatgg

SEQ ID NO: 73603 - DNA, 15 bp, Artificial Sequence
  dgRNA
  Cd19
cctttcctctatacg

SEQ ID NO: 73604 - DNA, 15 bp, Artificial Sequence
  dgRNA
  Myo6
aagaccccgcccctt

SEQ ID NO: 73605 - DNA, 15 bp, Artificial Sequence
  dgRNA
  Myo6
gctgttcccgcccac

SEQ ID NO: 73606 - DNA, 15 bp, Artificial Sequence
  dgRNA
  Myo6
ttagccgccccgccc

SEQ ID NO: 73607 - DNA, 15 bp, Artificial Sequence
  dgRNA
  Myo6
acaaaatcccgcctc

SEQ ID NO: 73608 - DNA, 15 bp, Artificial Sequence
  dgRNA
  Nsmf
cgcgctctcctacag

SEQ ID NO: 73609 - DNA, 15 bp, Artificial Sequence
  dgRNA
  Nsmf
cgcggctggacccgg

SEQ ID NO: 73610 - DNA, 15 bp, Artificial Sequence
  dgRNA
  Nsmf
gcgcggctggacccg

SEQ ID NO: 73611 - DNA, 15 bp, Artificial Sequence
  dgRNA
  Nsmf
agcgcggctggaccc

SEQ ID NO: 73612 - DNA, 15 bp, Artificial Sequence
  dgRNA
  Ccdc25
aaccagacgcttgag

SEQ ID NO: 73613 - DNA, 15 bp, Artificial Sequence
  dgRNA
  Ccdc25
cactcaacccaatat

SEQ ID NO: 73614 - DNA, 15 bp, Artificial Sequence
  dgRNA
  Ccdc25
ccactcaacccaata

SEQ ID NO: 73615 - DNA, 15 bp, Artificial Sequence
  dgRNA
  Ccdc25
agtggacacgagagt

SEQ ID NO: 73616 - DNA, 15 bp, Artificial Sequence
  dgRNA
  Irf1
caccgacgggtgccg

SEQ ID NO: 73617 - DNA, 15 bp, Artificial Sequence
  dgRNA
  Irf1
gtgccgtggaacaaa

SEQ ID NO: 73618 - DNA, 15 bp, Artificial Sequence
  dgRNA
  Irf1
gaacaaaaggcgcac

SEQ ID NO: 73619 - DNA, 15 bp, Artificial Sequence
  dgRNA
  Irf1
ggcgcacgggacacc

SEQ ID NO: 73620 - DNA, 15 bp, Artificial Sequence
  dgRNA
  Klhl38
tgtaaacactcgcca

SEQ ID NO: 73621 - DNA, 15 bp, Artificial Sequence
  dgRNA
  Klhl38
ctcgccaaggaaaca

SEQ ID NO: 73622 - DNA, 15 bp, Artificial Sequence
  dgRNA
  Klhl38
catgcgcagccctgc

SEQ ID NO: 73623 - DNA, 15 bp, Artificial Sequence
  dgRNA
  Klhl38
ctgcaggccctcggg

SEQ ID NO: 73624 - DNA, 15 bp, Artificial Sequence
  dgRNA
  Rasa4
tcgagagcaccagga

SEQ ID NO: 73625 - DNA, 15 bp, Artificial Sequence
  dgRNA
  Rasa4
agcagctacacttcg

SEQ ID NO: 73626 - DNA, 15 bp, Artificial Sequence
  dgRNA
  Rasa4
gctacacttcggggc

SEQ ID NO: 73627 - DNA, 15 bp, Artificial Sequence
  dgRNA
  Rasa4
tccaggtggccaatg

SEQ ID NO: 73628 - DNA, 15 bp, Artificial Sequence
  dgRNA
  Cct5
tccccgctgcaactc

SEQ ID NO: 73629 - DNA, 15 bp, Artificial Sequence
  dgRNA
  Cct5
ccccccctcggttcg

SEQ ID NO: 73630 - DNA, 15 bp, Artificial Sequence
  dgRNA
  Cct5
tcggttcgtggaaaa

SEQ ID NO: 73631 - DNA, 15 bp, Artificial Sequence
  dgRNA
  Cct5
ggacgttcccaacag

SEQ ID NO: 73632 - DNA, 15 bp, Artificial Sequence
  dgRNA
  Adrb3
gtggcgatagacctg

SEQ ID NO: 73633 - DNA, 15 bp, Artificial Sequence
  dgRNA
  Adrb3
agaaactagagtcga

SEQ ID NO: 73634 - DNA, 15 bp, Artificial Sequence
  dgRNA
  Adrb3
aagaaactagagtcg

SEQ ID NO: 73635 - DNA, 15 bp, Artificial Sequence
  dgRNA
  Gm5800
caagaggtaaaccct

SEQ ID NO: 73636 - DNA, 15 bp, Artificial Sequence
  dgRNA
  Gm5800
aaaaattcgtcaaga

SEQ ID NO: 73637 - DNA, 15 bp, Artificial Sequence
  dgRNA
  Gm5800
aaaattcgtcaagat

SEQ ID NO: 73638 - DNA, 15 bp, Artificial Sequence
  dgRNA
  Gm5800
aaattcgtcaagatg

SEQ ID NO: 73639 - DNA, 15 bp, Artificial Sequence
  dgRNA
  Myzap
ggagacgctcaactt

SEQ ID NO: 73640 - DNA, 15 bp, Artificial Sequence
  dgRNA
  Myzap
gagacgctcaacttt

SEQ ID NO: 73641 - DNA, 15 bp, Artificial Sequence
  dgRNA
  Myzap
agacgctcaactttg

SEQ ID NO: 73642 - DNA, 15 bp, Artificial Sequence
  dgRNA
  Myzap
tatcccctgtccttt

SEQ ID NO: 73643 - DNA, 15 bp, Artificial Sequence
  dgRNA
  Gpr3
acagagagccggctc

SEQ ID NO: 73644 - DNA, 15 bp, Artificial Sequence
  dgRNA
  Gpr3
gagagccggctccgg

SEQ ID NO: 73645 - DNA, 15 bp, Artificial Sequence
  dgRNA
  Gpr3
agagccggctccgga

SEQ ID NO: 73646 - DNA, 15 bp, Artificial Sequence
  dgRNA
  Gpr3
gcggggccgcggcca

SEQ ID NO: 73647 - DNA, 15 bp, Artificial Sequence
  dgRNA
  Cyb561d2
gagggcaaaattcta

SEQ ID NO: 73648 - DNA, 15 bp, Artificial Sequence
  dgRNA
  Cyb561d2
ggcaaaattctacgg

SEQ ID NO: 73649 - DNA, 15 bp, Artificial Sequence
  dgRNA
  Cyb561d2
aaaattctacggtgg

SEQ ID NO: 73650 - DNA, 15 bp, Artificial Sequence
  dgRNA
  Cyb561d2
gaggtacagcgtgtc

SEQ ID NO: 73651 - DNA, 15 bp, Artificial Sequence
  dgRNA
  Plp1
ggagcccttaaagaa

SEQ ID NO: 73652 - DNA, 15 bp, Artificial Sequence
  dgRNA
  Plp1
aagggagtatcccaa

SEQ ID NO: 73653 - DNA, 15 bp, Artificial Sequence
  dgRNA
  Plp1
ggggtgtaaattaaa

SEQ ID NO: 73654 - DNA, 15 bp, Artificial Sequence
  dgRNA
  Plp1
atactcccttcttta

SEQ ID NO: 73655 - DNA, 15 bp, Artificial Sequence
  dgRNA
  Lypla1
cctgctacctgccgc

SEQ ID NO: 73656 - DNA, 15 bp, Artificial Sequence
  dgRNA
  Lypla1
acctgccgctggtcc

SEQ ID NO: 73657 - DNA, 15 bp, Artificial Sequence
  dgRNA
  Lypla1
caggcactgcgggcg

SEQ ID NO: 73658 - DNA, 15 bp, Artificial Sequence
  dgRNA
  Lypla1
cactgcgggcgtgga

SEQ ID NO: 73659 - DNA, 15 bp, Artificial Sequence
  dgRNA
  Hoxd9
ggggtccgcccttaa

SEQ ID NO: 73660 - DNA, 15 bp, Artificial Sequence
  dgRNA
  Hoxd9
actgctccggggctt

SEQ ID NO: 73661 - DNA, 15 bp, Artificial Sequence
  dgRNA
  Hoxd9
tttggataatcgcct

SEQ ID NO: 73662 - DNA, 15 bp, Artificial Sequence
  dgRNA
  Hoxd9
ttagaagcccggccc

SEQ ID NO: 73663 - DNA, 15 bp, Artificial Sequence
  dgRNA
  Gm6614
gtatatgtcatctac

SEQ ID NO: 73664 - DNA, 15 bp, Artificial Sequence
  dgRNA
  Kitl
gtctatccgaccacg

SEQ ID NO: 73665 - DNA, 15 bp, Artificial Sequence
  dgRNA
  Kitl
cgcggctcctgagcc

SEQ ID NO: 73666 - DNA, 15 bp, Artificial Sequence
  dgRNA
  Kitl
cctctccactgtgcg

SEQ ID NO: 73667 - DNA, 15 bp, Artificial Sequence
  dgRNA
  Kitl
gtgcgcggtgcaacg

SEQ ID NO: 73668 - DNA, 15 bp, Artificial Sequence
  dgRNA
  Plxnc1
ttcccggccgagccg

SEQ ID NO: 73669 - DNA, 15 bp, Artificial Sequence
  dgRNA
  Plxnc1
tcccggccgagccgc

SEQ ID NO: 73670 - DNA, 15 bp, Artificial Sequence
  dgRNA
  Plxnc1
cccggccgagccgcg

SEQ ID NO: 73671 - DNA, 15 bp, Artificial Sequence
  dgRNA
  Plxnc1
gccgagccgcgggga

SEQ ID NO: 73672 - DNA, 15 bp, Artificial Sequence
  dgRNA
  Sbf1
caccggtcaggatta

SEQ ID NO: 73673 - DNA, 15 bp, Artificial Sequence
  dgRNA
  Sbf1
ccaccggtcaggatt

SEQ ID NO: 73674 - DNA, 15 bp, Artificial Sequence
  dgRNA
  Sbf1
gaagcaccaccggtc

SEQ ID NO: 73675 - DNA, 15 bp, Artificial Sequence
  dgRNA
  Arpc5l
agcggacagaagcgc

SEQ ID NO: 73676 - DNA, 15 bp, Artificial Sequence
  dgRNA
  Arpc5l
gctataccagcagcc

SEQ ID NO: 73677 - DNA, 15 bp, Artificial Sequence
  dgRNA
  Arpc5l
ccagcagcccggctt

SEQ ID NO: 73678 - DNA, 15 bp, Artificial Sequence
  dgRNA
  Arpc5l
agcccggcttcggag

SEQ ID NO: 73679 - DNA, 15 bp, Artificial Sequence
  dgRNA
  Dnd1
cactccgcccagttt

SEQ ID NO: 73680 - DNA, 15 bp, Artificial Sequence
  dgRNA
  Dnd1
gcccagttttggcga

SEQ ID NO: 73681 - DNA, 15 bp, Artificial Sequence
  dgRNA
  Dnd1
acccacggtcctaag

SEQ ID NO: 73682 - DNA, 15 bp, Artificial Sequence
  dgRNA
  Dnd1
cccacggtcctaagt

SEQ ID NO: 73683 - DNA, 15 bp, Artificial Sequence
  dgRNA
  Lrrc8d
atcccggtcacctcc

SEQ ID NO: 73684 - DNA, 15 bp, Artificial Sequence
  dgRNA
  Lrrc8d
gcccctcgggtcagc

SEQ ID NO: 73685 - DNA, 15 bp, Artificial Sequence
  dgRNA
  Lrrc8d
ccggaccgaccccct

SEQ ID NO: 73686 - DNA, 15 bp, Artificial Sequence
  dgRNA
  Lrrc8d
accgaccccctaggc

SEQ ID NO: 73687 - DNA, 15 bp, Artificial Sequence
  dgRNA
  Taar6
gtcatcctgttggat

SEQ ID NO: 73688 - DNA, 15 bp, Artificial Sequence
  dgRNA
  Taar6
accgaattcaattac

SEQ ID NO: 73689 - DNA, 15 bp, Artificial Sequence
  dgRNA
  Taar6
tgctgctatttgcac

SEQ ID NO: 73690 - DNA, 15 bp, Artificial Sequence
  dgRNA
  S1pr3
gcacttaaaattagc

SEQ ID NO: 73691 - DNA, 15 bp, Artificial Sequence
  dgRNA
  S1pr3
gtcagagtataggtt

SEQ ID NO: 73692 - DNA, 15 bp, Artificial Sequence
  dgRNA
  S1pr3
gtagatgatcggcag

SEQ ID NO: 73693 - DNA, 15 bp, Artificial Sequence
  dgRNA
  S1pr3
gatcggcagaggaat

SEQ ID NO: 73694 - DNA, 15 bp, Artificial Sequence
  dgRNA
  Hacd4
ttggaaagcctcggg

SEQ ID NO: 73695 - DNA, 15 bp, Artificial Sequence
  dgRNA
  Hacd4
aagcacatccgcccg

SEQ ID NO: 73696 - DNA, 15 bp, Artificial Sequence
  dgRNA
  Hacd4
ggctcgggaagggcg

SEQ ID NO: 73697 - DNA, 15 bp, Artificial Sequence
  dgRNA
  Hacd4
gggacgcctcaggct

SEQ ID NO: 73698 - DNA, 15 bp, Artificial Sequence
  dgRNA
  2310007B03Rik
gcacaactctgagca

SEQ ID NO: 73699 - DNA, 15 bp, Artificial Sequence
  dgRNA
  2310007B03Rik
gaggcggcaccgggc

SEQ ID NO: 73700 - DNA, 15 bp, Artificial Sequence
  dgRNA
  2310007B03Rik
aggcggcaccgggca

SEQ ID NO: 73701 - DNA, 15 bp, Artificial Sequence
  dgRNA
  2310007B03Rik
tccatacctgccagt

SEQ ID NO: 73702 - DNA, 15 bp, Artificial Sequence
  dgRNA
  Pex10
cccacccctatgtcg

SEQ ID NO: 73703 - DNA, 15 bp, Artificial Sequence
  dgRNA
  Pex10
acagatgtcacgcct

SEQ ID NO: 73704 - DNA, 15 bp, Artificial Sequence
  dgRNA
  Pex10
ccgccttcgcccgcg

SEQ ID NO: 73705 - DNA, 15 bp, Artificial Sequence
  dgRNA
  Pex10
aggtagatacctagt

SEQ ID NO: 73706 - DNA, 15 bp, Artificial Sequence
  dgRNA
  Taf10
taaagtattcagtcc

SEQ ID NO: 73707 - DNA, 15 bp, Artificial Sequence
  dgRNA
  Taf10
ctctgcggccccacc

SEQ ID NO: 73708 - DNA, 15 bp, Artificial Sequence
  dgRNA
  Taf10
cggccccacccgggc

SEQ ID NO: 73709 - DNA, 15 bp, Artificial Sequence
  dgRNA
  Taf10
gccccacccgggccg

SEQ ID NO: 73710 - DNA, 15 bp, Artificial Sequence
  dgRNA
  Naif1
actccaattcgacaa

SEQ ID NO: 73711 - DNA, 15 bp, Artificial Sequence
  dgRNA
  Naif1
ctccaattcgacaaa

SEQ ID NO: 73712 - DNA, 15 bp, Artificial Sequence
  dgRNA
  Naif1
atccctttgtcgaat

SEQ ID NO: 73713 - DNA, 15 bp, Artificial Sequence
  dgRNA
  Mustn1
cccctgctaatgtgc

SEQ ID NO: 73714 - DNA, 15 bp, Artificial Sequence
  dgRNA
  Mustn1
ccctgctaatgtgct

SEQ ID NO: 73715 - DNA, 15 bp, Artificial Sequence
  dgRNA
  Mustn1
tcccagcacattagc

SEQ ID NO: 73716 - DNA, 15 bp, Artificial Sequence
  dgRNA
  Mustn1
ggccctgaacaaggg

SEQ ID NO: 73717 - DNA, 15 bp, Artificial Sequence
  dgRNA
  Olfr1355
ttgaataatggtgcc

SEQ ID NO: 73718 - DNA, 15 bp, Artificial Sequence
  dgRNA
  Olfr1355
ttaactatactctaa

SEQ ID NO: 73719 - DNA, 15 bp, Artificial Sequence
  dgRNA
  Olfr1355
agatgattaccctct

SEQ ID NO: 73720 - DNA, 15 bp, Artificial Sequence
  dgRNA
  Olfr1355
tagatgattaccctc

SEQ ID NO: 73721 - DNA, 15 bp, Artificial Sequence
  dgRNA
  Mkl2
ctggcatgtaataga

SEQ ID NO: 73722 - DNA, 15 bp, Artificial Sequence
  dgRNA
  Mkl2
tgtaatagatggtca

SEQ ID NO: 73723 - DNA, 15 bp, Artificial Sequence
  dgRNA
  Mkl2
ggatccacagatgat

SEQ ID NO: 73724 - DNA, 15 bp, Artificial Sequence
  dgRNA
  Mkl2
gatagatgggcgctg

SEQ ID NO: 73725 - DNA, 15 bp, Artificial Sequence
  dgRNA
  Acad11
ggtaaattctaagtc

SEQ ID NO: 73726 - DNA, 15 bp, Artificial Sequence
  dgRNA
  Acad11
gtctggtcccacaac

SEQ ID NO: 73727 - DNA, 15 bp, Artificial Sequence
  dgRNA
  Acad11
actccgcctcccaca

SEQ ID NO: 73728 - DNA, 15 bp, Artificial Sequence
  dgRNA
  Acad11
cagagtcccggtgat

SEQ ID NO: 73729 - DNA, 15 bp, Artificial Sequence
  dgRNA
  Avpi1
gactgacgtcaatca

SEQ ID NO: 73730 - DNA, 15 bp, Artificial Sequence
  dgRNA
  Avpi1
actgacgtcaatcaa

SEQ ID NO: 73731 - DNA, 15 bp, Artificial Sequence
  dgRNA
  Avpi1
ctgacgtcaatcaag

SEQ ID NO: 73732 - DNA, 15 bp, Artificial Sequence
  dgRNA
  Avpi1
tgacgtcaatcaagg

SEQ ID NO: 73733 - DNA, 15 bp, Artificial Sequence
  dgRNA
  Ivd
ggaaacaagtacggg

SEQ ID NO: 73734 - DNA, 15 bp, Artificial Sequence
  dgRNA
  Ivd
ctggctgccgcctct

SEQ ID NO: 73735 - DNA, 15 bp, Artificial Sequence
  dgRNA
  Ivd
cgcctctcggctgat

SEQ ID NO: 73736 - DNA, 15 bp, Artificial Sequence
  dgRNA
  Ivd
cttgcatggttgcaa

SEQ ID NO: 73737 - DNA, 15 bp, Artificial Sequence
  dgRNA
  Ell
ggcctgtaagtgctt

SEQ ID NO: 73738 - DNA, 15 bp, Artificial Sequence
  dgRNA
  Ell
gcctgtaagtgcttg

SEQ ID NO: 73739 - DNA, 15 bp, Artificial Sequence
  dgRNA
  Ell
cgtggccatctgtgc

SEQ ID NO: 73740 - DNA, 15 bp, Artificial Sequence
  dgRNA
  Ell
atctgtgcgggcccg

SEQ ID NO: 73741 - DNA, 15 bp, Artificial Sequence
  dgRNA
  Sgca
gataccaaaaatagc

SEQ ID NO: 73742 - DNA, 15 bp, Artificial Sequence
  dgRNA
  Sgca
agggtgtcacacggg

SEQ ID NO: 73743 - DNA, 15 bp, Artificial Sequence
  dgRNA
  Sgca
tcacacgggaggctc

SEQ ID NO: 73744 - DNA, 15 bp, Artificial Sequence
  dgRNA
  Sgca
cttagatcacactct

SEQ ID NO: 73745 - DNA, 15 bp, Artificial Sequence
  dgRNA
  Vmn1r90
caatgcatactttga

SEQ ID NO: 73746 - DNA, 15 bp, Artificial Sequence
  dgRNA
  Pxylp1
gaaagcgcgcgcact

SEQ ID NO: 73747 - DNA, 15 bp, Artificial Sequence
  dgRNA
  6720489N17Rik
cgcactctaaccgta

SEQ ID NO: 73748 - DNA, 15 bp, Artificial Sequence
  dgRNA
  6720489N17Rik
gcactctaaccgtaa

SEQ ID NO: 73749 - DNA, 15 bp, Artificial Sequence
  dgRNA
  6720489N17Rik
actcacgaaccaatc

SEQ ID NO: 73750 - DNA, 15 bp, Artificial Sequence
  dgRNA
  6720489N17Rik
ctcacgaaccaatca

SEQ ID NO: 73751 - DNA, 15 bp, Artificial Sequence
  dgRNA
  Chrna7
ggagcaagtagctcg

SEQ ID NO: 73752 - DNA, 15 bp, Artificial Sequence
  dgRNA
  Chrna7
gtagctcggggtcag

SEQ ID NO: 73753 - DNA, 15 bp, Artificial Sequence
  dgRNA
  Chrna7
atcaactagctgagc

SEQ ID NO: 73754 - DNA, 15 bp, Artificial Sequence
  dgRNA
  Chrna7
tcaactagctgagca

SEQ ID NO: 73755 - DNA, 15 bp, Artificial Sequence
  dgRNA
  Bcr
cggggctgcggccgt

SEQ ID NO: 73756 - DNA, 15 bp, Artificial Sequence
  dgRNA
  Bcr
gctgcggccgtgggc

SEQ ID NO: 73757 - DNA, 15 bp, Artificial Sequence
  dgRNA
  Bcr
gcggccgtgggccgg

SEQ ID NO: 73758 - DNA, 15 bp, Artificial Sequence
  dgRNA
  Bcr
gccgtgggccggcgg

SEQ ID NO: 73759 - DNA, 15 bp, Artificial Sequence
  dgRNA
  Exog
gcgattggaccattc

SEQ ID NO: 73760 - DNA, 15 bp, Artificial Sequence
  dgRNA
  Exog
ggaccattccggcct

SEQ ID NO: 73761 - DNA, 15 bp, Artificial Sequence
  dgRNA
  Exog
gaatggtccaatcgc

SEQ ID NO: 73762 - DNA, 15 bp, Artificial Sequence
  dgRNA
  Exog
gctccgaggccggaa

SEQ ID NO: 73763 - DNA, 15 bp, Artificial Sequence
  dgRNA
  Pdf
tacgcgcttctgcag

SEQ ID NO: 73764 - DNA, 15 bp, Artificial Sequence
  dgRNA
  Pdf
acgcgcttctgcagc

SEQ ID NO: 73765 - DNA, 15 bp, Artificial Sequence
  dgRNA
  Pdf
gcttctgcagcggga

SEQ ID NO: 73766 - DNA, 15 bp, Artificial Sequence
  dgRNA
  Pdf
gcagttgctttgccc

SEQ ID NO: 73767 - DNA, 15 bp, Artificial Sequence
  dgRNA
  Sval3
aggtcaatatccagc

SEQ ID NO: 73768 - DNA, 15 bp, Artificial Sequence
  dgRNA
  Abat
tggctcggcgaagct

SEQ ID NO: 73769 - DNA, 15 bp, Artificial Sequence
  dgRNA
  Abat
ggctcggcgaagctt

SEQ ID NO: 73770 - DNA, 15 bp, Artificial Sequence
  dgRNA
  Abat
cgaagcttgggagcc

SEQ ID NO: 73771 - DNA, 15 bp, Artificial Sequence
  dgRNA
  Abat
agcctggtgagtcgc

SEQ ID NO: 73772 - DNA, 15 bp, Artificial Sequence
  dgRNA
  Rps6kl1
gccttgcaaactcta

SEQ ID NO: 73773 - DNA, 15 bp, Artificial Sequence
  dgRNA
  Rps6kl1
gagaacgatgattgg

SEQ ID NO: 73774 - DNA, 15 bp, Artificial Sequence
  dgRNA
  Rps6kl1
ggaggtttattctaa

SEQ ID NO: 73775 - DNA, 15 bp, Artificial Sequence
  dgRNA
  Rps6kl1
gaggtttattctaac

SEQ ID NO: 73776 - DNA, 15 bp, Artificial Sequence
  dgRNA
  Arid4a
aataacgtgcgtgtt

SEQ ID NO: 73777 - DNA, 15 bp, Artificial Sequence
  dgRNA
  Arid4a
tttccgcaccaatca

SEQ ID NO: 73778 - DNA, 15 bp, Artificial Sequence
  dgRNA
  Arid4a
caatccgaagctatt

SEQ ID NO: 73779 - DNA, 15 bp, Artificial Sequence
  dgRNA
  Arid4a
tcatgagcagccaat

SEQ ID NO: 73780 - DNA, 15 bp, Artificial Sequence
  dgRNA
  Sgk3
cagagcggacccggg

SEQ ID NO: 73781 - DNA, 15 bp, Artificial Sequence
  dgRNA
  Angel2
agtatttcctcaacg

SEQ ID NO: 73782 - DNA, 15 bp, Artificial Sequence
  dgRNA
  Angel2
acgtaaatacacttt

SEQ ID NO: 73783 - DNA, 15 bp, Artificial Sequence
  dgRNA
  Angel2
gccttccgccctacc

SEQ ID NO: 73784 - DNA, 15 bp, Artificial Sequence
  dgRNA
  Angel2
cgccctaccaggaaa

SEQ ID NO: 73785 - DNA, 15 bp, Artificial Sequence
  dgRNA
  Cpne1
gggaacgcggagcgc

SEQ ID NO: 73786 - DNA, 15 bp, Artificial Sequence
  dgRNA
  Vmn2r75
atagtggtgcctgga

SEQ ID NO: 73787 - DNA, 15 bp, Artificial Sequence
  dgRNA
  Ifnb1
cagccgacaccagcc

SEQ ID NO: 73788 - DNA, 15 bp, Artificial Sequence
  dgRNA
  Ifnb1
gctatttataaggga

SEQ ID NO: 73789 - DNA, 15 bp, Artificial Sequence
  dgRNA
  Ifnb1
gctacctgcaagatg

SEQ ID NO: 73790 - DNA, 15 bp, Artificial Sequence
  dgRNA
  Ercc6
tacaagccgctcaaa

SEQ ID NO: 73791 - DNA, 15 bp, Artificial Sequence
  dgRNA
  Ercc6
gacaaaggccacgcg

SEQ ID NO: 73792 - DNA, 15 bp, Artificial Sequence
  dgRNA
  Ercc6
acgcgcggctccctt

SEQ ID NO: 73793 - DNA, 15 bp, Artificial Sequence
  dgRNA
  Ercc6
tttggtcaacgcacg

SEQ ID NO: 73794 - DNA, 15 bp, Artificial Sequence
  dgRNA
  Rhox11
cctgtcttagaccca

SEQ ID NO: 73795 - DNA, 15 bp, Artificial Sequence
  dgRNA
  Rhox11
acaggatcttgacta

SEQ ID NO: 73796 - DNA, 15 bp, Artificial Sequence
  dgRNA
  Rhox11
ccctgggtctaagac

SEQ ID NO: 73797 - DNA, 15 bp, Artificial Sequence
  dgRNA
  Rhox11
gttggatctcagtta

SEQ ID NO: 73798 - DNA, 15 bp, Artificial Sequence
  dgRNA
  Zfp280d
cggcctagctcagcc

SEQ ID NO: 73799 - DNA, 15 bp, Artificial Sequence
  dgRNA
  Zfp280d
cccgcgtgtcctcgc

SEQ ID NO: 73800 - DNA, 15 bp, Artificial Sequence
  dgRNA
  Zfp280d
tcctcgccggctgct

SEQ ID NO: 73801 - DNA, 15 bp, Artificial Sequence
  dgRNA
  Zfp280d
cctcgccggctgcta

SEQ ID NO: 73802 - DNA, 15 bp, Artificial Sequence
  dgRNA
  Dusp16
gggcgatgcgcggcc

SEQ ID NO: 73803 - DNA, 15 bp, Artificial Sequence
  dgRNA
  Dusp16
ggcgatgcgcggcct

SEQ ID NO: 73804 - DNA, 15 bp, Artificial Sequence
  dgRNA
  Dusp16
atgcgcggcctgggc

SEQ ID NO: 73805 - DNA, 15 bp, Artificial Sequence
  dgRNA
  Dusp16
gcatcgcccgcccct

SEQ ID NO: 73806 - DNA, 15 bp, Artificial Sequence
  dgRNA
  Slitrk4
agtgggggcgtctgc

SEQ ID NO: 73807 - DNA, 15 bp, Artificial Sequence
  dgRNA
  Slitrk4
gggggcgtctgctgg

SEQ ID NO: 73808 - DNA, 15 bp, Artificial Sequence
  dgRNA
  Slitrk4
ggggcgtctgctgga

SEQ ID NO: 73809 - DNA, 15 bp, Artificial Sequence
  dgRNA
  Slitrk4
gaagtgatcggtgtc

SEQ ID NO: 73810 - DNA, 15 bp, Artificial Sequence
  dgRNA
  Zscan25
cccaagccagttgat

SEQ ID NO: 73811 - DNA, 15 bp, Artificial Sequence
  dgRNA
  Zscan25
gtgtagacccggaaa

SEQ ID NO: 73812 - DNA, 15 bp, Artificial Sequence
  dgRNA
  Zscan25
agacccggaaatgga

SEQ ID NO: 73813 - DNA, 15 bp, Artificial Sequence
  dgRNA
  Zscan25
gacccggaaatggat

SEQ ID NO: 73814 - DNA, 15 bp, Artificial Sequence
  dgRNA
  Samd4
gttacctgctactac

SEQ ID NO: 73815 - DNA, 15 bp, Artificial Sequence
  dgRNA
  Samd4
gccaccagtagtagc

SEQ ID NO: 73816 - DNA, 15 bp, Artificial Sequence
  dgRNA
  Tmem9b
gggatggggttcacc

SEQ ID NO: 73817 - DNA, 15 bp, Artificial Sequence
  dgRNA
  Tmem9b
ggttcacccggcctg

SEQ ID NO: 73818 - DNA, 15 bp, Artificial Sequence
  dgRNA
  Tmem9b
gttcacccggcctgc

SEQ ID NO: 73819 - DNA, 15 bp, Artificial Sequence
  dgRNA
  Tmem9b
gggactagatccgca

SEQ ID NO: 73820 - DNA, 15 bp, Artificial Sequence
  dgRNA
  Mdh1
ccgagctcaccagcc

SEQ ID NO: 73821 - DNA, 15 bp, Artificial Sequence
  dgRNA
  Mdh1
cgagctcaccagcct

SEQ ID NO: 73822 - DNA, 15 bp, Artificial Sequence
  dgRNA
  Mdh1
gtctggagagcgctc

SEQ ID NO: 73823 - DNA, 15 bp, Artificial Sequence
  dgRNA
  Mdh1
gagagcgctcaggtg

SEQ ID NO: 73824 - DNA, 15 bp, Artificial Sequence
  dgRNA
  Col4a1
tgggcgccggactct

SEQ ID NO: 73825 - DNA, 15 bp, Artificial Sequence
  dgRNA
  Col4a1
ccggactctcggccc

SEQ ID NO: 73826 - DNA, 15 bp, Artificial Sequence
  dgRNA
  Col4a1
cccggcgtgccttgc

SEQ ID NO: 73827 - DNA, 15 bp, Artificial Sequence
  dgRNA
  Col4a1
gggattggcgagcca

SEQ ID NO: 73828 - DNA, 15 bp, Artificial Sequence
  dgRNA
  Gkap1
gcggcccccgtagcg

SEQ ID NO: 73829 - DNA, 15 bp, Artificial Sequence
  dgRNA
  Gkap1
cgcggctcctccagc

SEQ ID NO: 73830 - DNA, 15 bp, Artificial Sequence
  dgRNA
  Gkap1
tccagcaggtggttc

SEQ ID NO: 73831 - DNA, 15 bp, Artificial Sequence
  dgRNA
  Gkap1
gcagtccgtcccccg

SEQ ID NO: 73832 - DNA, 15 bp, Artificial Sequence
  dgRNA
  Satb1
tctacccagctgaag

SEQ ID NO: 73833 - DNA, 15 bp, Artificial Sequence
  dgRNA
  Satb1
gggaacagccgaggg

SEQ ID NO: 73834 - DNA, 15 bp, Artificial Sequence
  dgRNA
  Satb1
gaagggaacagccga

SEQ ID NO: 73835 - DNA, 15 bp, Artificial Sequence
  dgRNA
  Satb1
tgaagggaacagccg

SEQ ID NO: 73836 - DNA, 15 bp, Artificial Sequence
  dgRNA
  Ddb1
gggtactgcgacctc

SEQ ID NO: 73837 - DNA, 15 bp, Artificial Sequence
  dgRNA
  Ddb1
tactgcgacctctgg

SEQ ID NO: 73838 - DNA, 15 bp, Artificial Sequence
  dgRNA
  Ddb1
cgacctctggcggtt

SEQ ID NO: 73839 - DNA, 15 bp, Artificial Sequence
  dgRNA
  Ddb1
ctggcggttaggaga

SEQ ID NO: 73840 - DNA, 15 bp, Artificial Sequence
  dgRNA
  Insl6
ctaaccaaagtgttc

SEQ ID NO: 73841 - DNA, 15 bp, Artificial Sequence
  dgRNA
  Insl6
agaagattgcctgcg

SEQ ID NO: 73842 - DNA, 15 bp, Artificial Sequence
  dgRNA
  Insl6
gaagattgcctgcga

SEQ ID NO: 73843 - DNA, 15 bp, Artificial Sequence
  dgRNA
  Insl6
gattgcctgcgaggg

SEQ ID NO: 73844 - DNA, 15 bp, Artificial Sequence
  dgRNA
  Psd3
atttgcctcttccgt

SEQ ID NO: 73845 - DNA, 15 bp, Artificial Sequence
  dgRNA
  Psd3
ggaaccggcccatct

SEQ ID NO: 73846 - DNA, 15 bp, Artificial Sequence
  dgRNA
  Psd3
ctgttccgacggaag

SEQ ID NO: 73847 - DNA, 15 bp, Artificial Sequence
  dgRNA
  Psd3
ctcacgctgttccga

SEQ ID NO: 73848 - DNA, 15 bp, Artificial Sequence
  dgRNA
  Ppp1r21
tccaacatggcgtct

SEQ ID NO: 73849 - DNA, 15 bp, Artificial Sequence
  dgRNA
  Ppp1r21
ccaacatggcgtcta

SEQ ID NO: 73850 - DNA, 15 bp, Artificial Sequence
  dgRNA
  Ppp1r21
ggcgtctagggtctc

SEQ ID NO: 73851 - DNA, 15 bp, Artificial Sequence
  dgRNA
  Ppp1r21
gcaaaagcaccgcac

SEQ ID NO: 73852 - DNA, 15 bp, Artificial Sequence
  dgRNA
  Ap1ar
agcagatccccgtct

SEQ ID NO: 73853 - DNA, 15 bp, Artificial Sequence
  dgRNA
  Ap1ar
tccccgtctaggatc

SEQ ID NO: 73854 - DNA, 15 bp, Artificial Sequence
  dgRNA
  Ap1ar
acagcgcctcctgcc

SEQ ID NO: 73855 - DNA, 15 bp, Artificial Sequence
  dgRNA
  Ap1ar
cgctgccagccaagc

SEQ ID NO: 73856 - DNA, 15 bp, Artificial Sequence
  dgRNA
  Pigf
acaacaacgccccag

SEQ ID NO: 73857 - DNA, 15 bp, Artificial Sequence
  dgRNA
  Pigf
gacgacttcctcttc

SEQ ID NO: 73858 - DNA, 15 bp, Artificial Sequence
  dgRNA
  Pigf
acgtcagcccgcttc

SEQ ID NO: 73859 - DNA, 15 bp, Artificial Sequence
  dgRNA
  Pigf
tcagccctcccgctc

SEQ ID NO: 73860 - DNA, 15 bp, Artificial Sequence
  dgRNA
  Txndc2
tccccactcacagcg

SEQ ID NO: 73861 - DNA, 15 bp, Artificial Sequence
  dgRNA
  Txndc2
tccacgctgtgagtg

SEQ ID NO: 73862 - DNA, 15 bp, Artificial Sequence
  dgRNA
  Txndc2
ttccacgctgtgagt

SEQ ID NO: 73863 - DNA, 15 bp, Artificial Sequence
  dgRNA
  Txndc2
cttccacgctgtgag

SEQ ID NO: 73864 - DNA, 15 bp, Artificial Sequence
  dgRNA
  Spink14
attctagttaggtca

SEQ ID NO: 73865 - DNA, 15 bp, Artificial Sequence
  dgRNA
  Spink14
tagctgcgtaggaga

SEQ ID NO: 73866 - DNA, 15 bp, Artificial Sequence
  dgRNA
  Spink14
ggacagtagctgcgt

SEQ ID NO: 73867 - DNA, 15 bp, Artificial Sequence
  dgRNA
  Spink14
ttggggcttctcgag

SEQ ID NO: 73868 - DNA, 15 bp, Artificial Sequence
  dgRNA
  Serpini2
attaacttgatcaca

SEQ ID NO: 73869 - DNA, 15 bp, Artificial Sequence
  dgRNA
  Serpini2
cacctgctatggttg

SEQ ID NO: 73870 - DNA, 15 bp, Artificial Sequence
  dgRNA
  Serpini2
ttccacaaccatagc

SEQ ID NO: 73871 - DNA, 15 bp, Artificial Sequence
  dgRNA
  Serpini2
gcagcttattggtga

SEQ ID NO: 73872 - DNA, 15 bp, Artificial Sequence
  dgRNA
  Olfr1023
taataccctgtaaga

SEQ ID NO: 73873 - DNA, 15 bp, Artificial Sequence
  dgRNA
  Alas1
aaggcgcatgcgcgg

SEQ ID NO: 73874 - DNA, 15 bp, Artificial Sequence
  dgRNA
  Alas1
gcgcggcggtcactc

SEQ ID NO: 73875 - DNA, 15 bp, Artificial Sequence
  dgRNA
  Alas1
tccggctctatattt

SEQ ID NO: 73876 - DNA, 15 bp, Artificial Sequence
  dgRNA
  Alas1
ccggctctatattta

SEQ ID NO: 73877 - DNA, 15 bp, Artificial Sequence
  dgRNA
  Prickle3
caaaccgtttgcttc

SEQ ID NO: 73878 - DNA, 15 bp, Artificial Sequence
  dgRNA
  Prickle3
ggccatgcggcaccg

SEQ ID NO: 73879 - DNA, 15 bp, Artificial Sequence
  dgRNA
  Prickle3
gccatgcggcaccga

SEQ ID NO: 73880 - DNA, 15 bp, Artificial Sequence
  dgRNA
  Prickle3
ctccggctctagccc

SEQ ID NO: 73881 - DNA, 15 bp, Artificial Sequence
  dgRNA
  Itpkb
tggcaaaccgaggga

SEQ ID NO: 73882 - DNA, 15 bp, Artificial Sequence
  dgRNA
  Itpkb
ttggcaaaccgaggg

SEQ ID NO: 73883 - DNA, 15 bp, Artificial Sequence
  dgRNA
  Itpkb
tgcttggcaaaccga

SEQ ID NO: 73884 - DNA, 15 bp, Artificial Sequence
  dgRNA
  Itpkb
ttgcttggcaaaccg

SEQ ID NO: 73885 - DNA, 15 bp, Artificial Sequence
  dgRNA
  Ralgps1
agccggccgccgctc

SEQ ID NO: 73886 - DNA, 15 bp, Artificial Sequence
  dgRNA
  Ralgps1
ccgccgctcaggccc

SEQ ID NO: 73887 - DNA, 15 bp, Artificial Sequence
  dgRNA
  Ralgps1
ggacggttcctactg

SEQ ID NO: 73888 - DNA, 15 bp, Artificial Sequence
  dgRNA
  Ralgps1
ggttcctactgcggc

SEQ ID NO: 73889 - DNA, 15 bp, Artificial Sequence
  dgRNA
  Abcg2
gaaccccccttccat

SEQ ID NO: 73890 - DNA, 15 bp, Artificial Sequence
  dgRNA
  Abcg2
gacaggaagtttacg

SEQ ID NO: 73891 - DNA, 15 bp, Artificial Sequence
  dgRNA
  Abcg2
acaggaagtttacgc

SEQ ID NO: 73892 - DNA, 15 bp, Artificial Sequence
  dgRNA
  Abcg2
caggaagtttacgcg

SEQ ID NO: 73893 - DNA, 15 bp, Artificial Sequence
  dgRNA
  Ubac2
gaaccggctcgctca

SEQ ID NO: 73894 - DNA, 15 bp, Artificial Sequence
  dgRNA
  Ubac2
gcgcttcacgccgta

SEQ ID NO: 73895 - DNA, 15 bp, Artificial Sequence
  dgRNA
  Ubac2
cgtaaggttctgtac

SEQ ID NO: 73896 - DNA, 15 bp, Artificial Sequence
  dgRNA
  Ubac2
gtaaggttctgtact

SEQ ID NO: 73897 - DNA, 15 bp, Artificial Sequence
  dgRNA
  Pde7a
cctgctttgcactag

SEQ ID NO: 73898 - DNA, 15 bp, Artificial Sequence
  dgRNA
  Pde7a
tttgcactagtggtg

SEQ ID NO: 73899 - DNA, 15 bp, Artificial Sequence
  dgRNA
  Pde7a
ctagtggtgaggtcg

SEQ ID NO: 73900 - DNA, 15 bp, Artificial Sequence
  dgRNA
  Pde7a
gcattaagcatgcgc

SEQ ID NO: 73901 - DNA, 15 bp, Artificial Sequence
  dgRNA
  Fiz1
ctccctagaagcacg

SEQ ID NO: 73902 - DNA, 15 bp, Artificial Sequence
  dgRNA
  Fiz1
cgcccaagcaacagt

SEQ ID NO: 73903 - DNA, 15 bp, Artificial Sequence
  dgRNA
  Fiz1
tagtctgtagtgcgc

SEQ ID NO: 73904 - DNA, 15 bp, Artificial Sequence
  dgRNA
  Fiz1
tgtagtgcgcaggct

SEQ ID NO: 73905 - DNA, 15 bp, Artificial Sequence
  dgRNA
  CT025529.1
tctatctagtttgga

SEQ ID NO: 73906 - DNA, 15 bp, Artificial Sequence
  dgRNA
  Mrpl51
agttgaggacgcgca

SEQ ID NO: 73907 - DNA, 15 bp, Artificial Sequence
  dgRNA
  Mrpl51
gttgaggacgcgcaa

SEQ ID NO: 73908 - DNA, 15 bp, Artificial Sequence
  dgRNA
  Mrpl51
ggacgcgcaagggac

SEQ ID NO: 73909 - DNA, 15 bp, Artificial Sequence
  dgRNA
  Mrpl51
aacggaatttcggtt

SEQ ID NO: 73910 - DNA, 15 bp, Artificial Sequence
  dgRNA
  Gpr150
cacggatgccactga

SEQ ID NO: 73911 - DNA, 15 bp, Artificial Sequence
  dgRNA
  Gpr150
agcgaaaagcggaga

SEQ ID NO: 73912 - DNA, 15 bp, Artificial Sequence
  dgRNA
  Gpr150
catccgtggacctct

SEQ ID NO: 73913 - DNA, 15 bp, Artificial Sequence
  dgRNA
  Gpr150
cctcagtggcatccg

SEQ ID NO: 73914 - DNA, 15 bp, Artificial Sequence
  dgRNA
  Meox1
aaatgccattagatg

SEQ ID NO: 73915 - DNA, 15 bp, Artificial Sequence
  dgRNA
  Meox1
aatgccattagatgt

SEQ ID NO: 73916 - DNA, 15 bp, Artificial Sequence
  dgRNA
  Meox1
taatgttgcctgctc

SEQ ID NO: 73917 - DNA, 15 bp, Artificial Sequence
  dgRNA
  Meox1
tgcctgctcgggttt

SEQ ID NO: 73918 - DNA, 15 bp, Artificial Sequence
  dgRNA
  Vamp8
aaaggttgcccaaca

SEQ ID NO: 73919 - DNA, 15 bp, Artificial Sequence
  dgRNA
  Vamp8
cgaagataccttgtt

SEQ ID NO: 73920 - DNA, 15 bp, Artificial Sequence
  dgRNA
  Vamp8
gcgaagataccttgt

SEQ ID NO: 73921 - DNA, 15 bp, Artificial Sequence
  dgRNA
  Vamp8
tagaaacgaatgtac

SEQ ID NO: 73922 - DNA, 15 bp, Artificial Sequence
  dgRNA
  Ryr2
cccgtgcaatccaaa

SEQ ID NO: 73923 - DNA, 15 bp, Artificial Sequence
  dgRNA
  Ryr2
ggcaagtactgtagc

SEQ ID NO: 73924 - DNA, 15 bp, Artificial Sequence
  dgRNA
  Ryr2
gatggctgagcgctc

SEQ ID NO: 73925 - DNA, 15 bp, Artificial Sequence
  dgRNA
  Ryr2
actgtgccccggcgc

SEQ ID NO: 73926 - DNA, 15 bp, Artificial Sequence
  dgRNA
  Jph4
gagtttgagctgaat

SEQ ID NO: 73927 - DNA, 15 bp, Artificial Sequence
  dgRNA
  Jph4
cgttcaaatgcctcc

SEQ ID NO: 73928 - DNA, 15 bp, Artificial Sequence
  dgRNA
  Jph4
ttccggccaagcagc

SEQ ID NO: 73929 - DNA, 15 bp, Artificial Sequence
  dgRNA
  Jph4
ggaggcatttgaacg

SEQ ID NO: 73930 - DNA, 15 bp, Artificial Sequence
  dgRNA
  Ikzf5
tgcgcaagactccct

SEQ ID NO: 73931 - DNA, 15 bp, Artificial Sequence
  dgRNA
  Ikzf5
tcggcctggcaagct

SEQ ID NO: 73932 - DNA, 15 bp, Artificial Sequence
  dgRNA
  Ikzf5
cggcctggcaagctc

SEQ ID NO: 73933 - DNA, 15 bp, Artificial Sequence
  dgRNA
  Ikzf5
gcccactgccgccta

SEQ ID NO: 73934 - DNA, 15 bp, Artificial Sequence
  dgRNA
  1810043H04Rik
gaccaatcgctcgca

SEQ ID NO: 73935 - DNA, 15 bp, Artificial Sequence
  dgRNA
  1810043H04Rik
accaatcgctcgcaa

SEQ ID NO: 73936 - DNA, 15 bp, Artificial Sequence
  dgRNA
  1810043H04Rik
ccaatcgctcgcaag

SEQ ID NO: 73937 - DNA, 15 bp, Artificial Sequence
  dgRNA
  1810043H04Rik
atcgctcgcaagggg

SEQ ID NO: 73938 - DNA, 15 bp, Artificial Sequence
  dgRNA
  Sohlh2
agcccgaggtttgag

SEQ ID NO: 73939 - DNA, 15 bp, Artificial Sequence
  dgRNA
  Sohlh2
tttgagtggcgtgcc

SEQ ID NO: 73940 - DNA, 15 bp, Artificial Sequence
  dgRNA
  Sohlh2
ttgagtggcgtgcct

SEQ ID NO: 73941 - DNA, 15 bp, Artificial Sequence
  dgRNA
  Sohlh2
cacgtcactctgccc

SEQ ID NO: 73942 - DNA, 15 bp, Artificial Sequence
  dgRNA
  Arl4d
aaaataaagcggttc

SEQ ID NO: 73943 - DNA, 15 bp, Artificial Sequence
  dgRNA
  Arl4d
ctcagtccccgcctc

SEQ ID NO: 73944 - DNA, 15 bp, Artificial Sequence
  dgRNA
  Arl4d
ctccgggacgctgat

SEQ ID NO: 73945 - DNA, 15 bp, Artificial Sequence
  dgRNA
  Arl4d
tccgggacgctgatt

SEQ ID NO: 73946 - DNA, 15 bp, Artificial Sequence
  dgRNA
  Cic
cgcccccggccggct

SEQ ID NO: 73947 - DNA, 15 bp, Artificial Sequence
  dgRNA
  Cic
tgactgacgttccct

SEQ ID NO: 73948 - DNA, 15 bp, Artificial Sequence
  dgRNA
  Cic
gactgacgttccctc

SEQ ID NO: 73949 - DNA, 15 bp, Artificial Sequence
  dgRNA
  Cic
actgacgttccctcg

SEQ ID NO: 73950 - DNA, 15 bp, Artificial Sequence
  dgRNA
  B3galt4
cgcgtgctttacagt

SEQ ID NO: 73951 - DNA, 15 bp, Artificial Sequence
  dgRNA
  B3galt4
gcgtgctttacagta

SEQ ID NO: 73952 - DNA, 15 bp, Artificial Sequence
  dgRNA
  B3galt4
acagtagggacggac

SEQ ID NO: 73953 - DNA, 15 bp, Artificial Sequence
  dgRNA
  B3galt4
cagtagggacggacc

SEQ ID NO: 73954 - DNA, 15 bp, Artificial Sequence
  dgRNA
  Vmn1r85
agatgtggtacctct

SEQ ID NO: 73955 - DNA, 15 bp, Artificial Sequence
  dgRNA
  Vmn1r85
cagatgtggtacctc

SEQ ID NO: 73956 - DNA, 15 bp, Artificial Sequence
  dgRNA
  Vmn1r85
gaccttcagtaaaaa

SEQ ID NO: 73957 - DNA, 15 bp, Artificial Sequence
  dgRNA
  Ahi1
cccgggactcgcttc

SEQ ID NO: 73958 - DNA, 15 bp, Artificial Sequence
  dgRNA
  Ahi1
ctcgcttccggctgc

SEQ ID NO: 73959 - DNA, 15 bp, Artificial Sequence
  dgRNA
  Ahi1
tcgcttccggctgca

SEQ ID NO: 73960 - DNA, 15 bp, Artificial Sequence
  dgRNA
  Ahi1
cgcttccggctgcag

SEQ ID NO: 73961 - DNA, 15 bp, Artificial Sequence
  dgRNA
  Foxp1
gatctcccagtttcg

SEQ ID NO: 73962 - DNA, 15 bp, Artificial Sequence
  dgRNA
  Foxp1
tttcgtggtgtcccc

SEQ ID NO: 73963 - DNA, 15 bp, Artificial Sequence
  dgRNA
  Foxp1
atttaatctagagta

SEQ ID NO: 73964 - DNA, 15 bp, Artificial Sequence
  dgRNA
  Foxp1
tctagagtaaggcag

SEQ ID NO: 73965 - DNA, 15 bp, Artificial Sequence
  dgRNA
  C2cd4a
gaaacaaactcgttc

SEQ ID NO: 73966 - DNA, 15 bp, Artificial Sequence
  dgRNA
  C2cd4a
aaacaaactcgttca

SEQ ID NO: 73967 - DNA, 15 bp, Artificial Sequence
  dgRNA
  C2cd4a
ccatccacgtggcag

SEQ ID NO: 73968 - DNA, 15 bp, Artificial Sequence
  dgRNA
  C2cd4a
cgtggcagagggacc

SEQ ID NO: 73969 - DNA, 15 bp, Artificial Sequence
  dgRNA
  Uhrf1bp1
gagagttcggagtaa

SEQ ID NO: 73970 - DNA, 15 bp, Artificial Sequence
  dgRNA
  Uhrf1bp1
acacgctcagaggcg

SEQ ID NO: 73971 - DNA, 15 bp, Artificial Sequence
  dgRNA
  Uhrf1bp1
tacacgctcagaggc

SEQ ID NO: 73972 - DNA, 15 bp, Artificial Sequence
  dgRNA
  Uhrf1bp1
ttacacgctcagagg

SEQ ID NO: 73973 - DNA, 15 bp, Artificial Sequence
  dgRNA
  1700024P16Rik
agaaactcccccaga

SEQ ID NO: 73974 - DNA, 15 bp, Artificial Sequence
  dgRNA
  1700024P16Rik
gaaactcccccagat

SEQ ID NO: 73975 - DNA, 15 bp, Artificial Sequence
  dgRNA
  1700024P16Rik
gagaggacccgactc

SEQ ID NO: 73976 - DNA, 15 bp, Artificial Sequence
  dgRNA
  1700024P16Rik
gaagcccgggaccag

SEQ ID NO: 73977 - DNA, 15 bp, Artificial Sequence
  dgRNA
  4933403O08Rik
aagttgtgtacacaa

SEQ ID NO: 73978 - DNA, 15 bp, Artificial Sequence
  dgRNA
  Dtx1
tttcccaatctaaac

SEQ ID NO: 73979 - DNA, 15 bp, Artificial Sequence
  dgRNA
  Dtx1
caatctaaacagggc

SEQ ID NO: 73980 - DNA, 15 bp, Artificial Sequence
  dgRNA
  Dtx1
agatcaccctgtagt

SEQ ID NO: 73981 - DNA, 15 bp, Artificial Sequence
  dgRNA
  Dtx1
ttaagggacctcttt

SEQ ID NO: 73982 - DNA, 15 bp, Artificial Sequence
  dgRNA
  Calcrl
tcgccttcaaatccc

SEQ ID NO: 73983 - DNA, 15 bp, Artificial Sequence
  dgRNA
  Calcrl
ctcagtctaggtgaa

SEQ ID NO: 73984 - DNA, 15 bp, Artificial Sequence
  dgRNA
  Calcrl
gcagccagcttttgc

SEQ ID NO: 73985 - DNA, 15 bp, Artificial Sequence
  dgRNA
  Calcrl
gtgtgtgtcgaatta

SEQ ID NO: 73986 - DNA, 15 bp, Artificial Sequence
  dgRNA
  Pcnx
caggcttctcccaac

SEQ ID NO: 73987 - DNA, 15 bp, Artificial Sequence
  dgRNA
  Pcnx
gcttctcccaacagg

SEQ ID NO: 73988 - DNA, 15 bp, Artificial Sequence
  dgRNA
  Pcnx
gcgcccgtgcgaccc

SEQ ID NO: 73989 - DNA, 15 bp, Artificial Sequence
  dgRNA
  Pcnx
cgctgcgcgtacccg

SEQ ID NO: 73990 - DNA, 15 bp, Artificial Sequence
  dgRNA
  Pcdh12
agtctactaactgtt

SEQ ID NO: 73991 - DNA, 15 bp, Artificial Sequence
  dgRNA
  Pcdh12
ggctgcgagtttcaa

SEQ ID NO: 73992 - DNA, 15 bp, Artificial Sequence
  dgRNA
  Pcdh12
ggaaaccccacctac

SEQ ID NO: 73993 - DNA, 15 bp, Artificial Sequence
  dgRNA
  Pcdh12
acagttagtagactg

SEQ ID NO: 73994 - DNA, 15 bp, Artificial Sequence
  dgRNA
  Klk4
gcagcatctgacgta

SEQ ID NO: 73995 - DNA, 15 bp, Artificial Sequence
  dgRNA
  Klk4
gcttataagccccat

SEQ ID NO: 73996 - DNA, 15 bp, Artificial Sequence
  dgRNA
  Klk4
cttataagccccata

SEQ ID NO: 73997 - DNA, 15 bp, Artificial Sequence
  dgRNA
  Klk4
ttataagccccatag

SEQ ID NO: 73998 - DNA, 15 bp, Artificial Sequence
  dgRNA
  Abca8a
agatttgttcgagaa

SEQ ID NO: 73999 - DNA, 15 bp, Artificial Sequence
  dgRNA
  Abca8a
cctccaaaagcagtc

SEQ ID NO: 74000 - DNA, 15 bp, Artificial Sequence
  dgRNA
  Abca8a
gggaatgctcaaaac

SEQ ID NO: 74001 - DNA, 15 bp, Artificial Sequence
  dgRNA
  Abca8a
atgtgatagagaccg

SEQ ID NO: 74002 - DNA, 15 bp, Artificial Sequence
  dgRNA
  Tspan3
gtaactcaataagac

SEQ ID NO: 74003 - DNA, 15 bp, Artificial Sequence
  dgRNA
  Tspan3
taactcaataagacg

SEQ ID NO: 74004 - DNA, 15 bp, Artificial Sequence
  dgRNA
  Tspan3
ttctacactcaagga

SEQ ID NO: 74005 - DNA, 15 bp, Artificial Sequence
  dgRNA
  Tspan3
ctcaaggacggtcag

SEQ ID NO: 74006 - DNA, 15 bp, Artificial Sequence
  dgRNA
  Tpm4
ccgctgggccaggcg

SEQ ID NO: 74007 - DNA, 15 bp, Artificial Sequence
  dgRNA
  Tpm4
cggggcgggcagtga

SEQ ID NO: 74008 - DNA, 15 bp, Artificial Sequence
  dgRNA
  Tpm4
ggacgaggagcccac

SEQ ID NO: 74009 - DNA, 15 bp, Artificial Sequence
  dgRNA
  Tpm4
gacgaggagcccaca

SEQ ID NO: 74010 - DNA, 15 bp, Artificial Sequence
  dgRNA
  Olfr1502
actctgatgtatgaa

SEQ ID NO: 74011 - DNA, 15 bp, Artificial Sequence
  dgRNA
  Ipo4
gggaactgtcggcac

SEQ ID NO: 74012 - DNA, 15 bp, Artificial Sequence
  dgRNA
  Ipo4
ggaactgtcggcaca

SEQ ID NO: 74013 - DNA, 15 bp, Artificial Sequence
  dgRNA
  Ipo4
gaacccacggtgccg

SEQ ID NO: 74014 - DNA, 15 bp, Artificial Sequence
  dgRNA
  Ipo4
ccgaggctctgtcag

SEQ ID NO: 74015 - DNA, 15 bp, Artificial Sequence
  dgRNA
  Mrpl21
tgcgctcctccacct

SEQ ID NO: 74016 - DNA, 15 bp, Artificial Sequence
  dgRNA
  Mrpl21
ccacgaaactctcca

SEQ ID NO: 74017 - DNA, 15 bp, Artificial Sequence
  dgRNA
  Mrpl21
cgaaactctccacgg

SEQ ID NO: 74018 - DNA, 15 bp, Artificial Sequence
  dgRNA
  Mrpl21
tctccacggtggacg

SEQ ID NO: 74019 - DNA, 15 bp, Artificial Sequence
  dgRNA
  Sumo3
ccgcggaacgcaggc

SEQ ID NO: 74020 - DNA, 15 bp, Artificial Sequence
  dgRNA
  Sumo3
cgcggaacgcaggcc

SEQ ID NO: 74021 - DNA, 15 bp, Artificial Sequence
  dgRNA
  Sumo3
gggccgcgcgcaaaa

SEQ ID NO: 74022 - DNA, 15 bp, Artificial Sequence
  dgRNA
  Sumo3
ggccgcgcgcaaaaa

SEQ ID NO: 74023 - DNA, 15 bp, Artificial Sequence
  dgRNA
  Olfr774
gtataattgttgaag

SEQ ID NO: 74024 - DNA, 15 bp, Artificial Sequence
  dgRNA
  Olfr774
cttcaacaattatac

SEQ ID NO: 74025 - DNA, 15 bp, Artificial Sequence
  dgRNA
  Pptc7
taactcctggatcac

SEQ ID NO: 74026 - DNA, 15 bp, Artificial Sequence
  dgRNA
  Pptc7
ttaactacgacttcc

SEQ ID NO: 74027 - DNA, 15 bp, Artificial Sequence
  dgRNA
  Pptc7
gcgcacgctcgattc

SEQ ID NO: 74028 - DNA, 15 bp, Artificial Sequence
  dgRNA
  Pptc7
ttccggtgactacat

SEQ ID NO: 74029 - DNA, 15 bp, Artificial Sequence
  dgRNA
  Rpl11
atgactgcagtttcg

SEQ ID NO: 74030 - DNA, 15 bp, Artificial Sequence
  dgRNA
  Rpl11
aggacagtccactag

SEQ ID NO: 74031 - DNA, 15 bp, Artificial Sequence
  dgRNA
  Rpl11
acagtccactagagg

SEQ ID NO: 74032 - DNA, 15 bp, Artificial Sequence
  dgRNA
  Rpl11
tgggttgtccgatgc

SEQ ID NO: 74033 - DNA, 15 bp, Artificial Sequence
  dgRNA
  Avp
gggacctgtcggctg

SEQ ID NO: 74034 - DNA, 15 bp, Artificial Sequence
  dgRNA
  Avp
ggacctgtcggctga

SEQ ID NO: 74035 - DNA, 15 bp, Artificial Sequence
  dgRNA
  Avp
tcggctgagggctcc

SEQ ID NO: 74036 - DNA, 15 bp, Artificial Sequence
  dgRNA
  Avp
cggctgagggctcct

SEQ ID NO: 74037 - DNA, 15 bp, Artificial Sequence
  dgRNA
  Cenpi
gatgcaagccttgtc

SEQ ID NO: 74038 - DNA, 15 bp, Artificial Sequence
  dgRNA
  Cenpi
cgccgcaggcctacg

SEQ ID NO: 74039 - DNA, 15 bp, Artificial Sequence
  dgRNA
  Cenpi
gccgcaggcctacgt

SEQ ID NO: 74040 - DNA, 15 bp, Artificial Sequence
  dgRNA
  Cenpi
ggccagagtttaatg

SEQ ID NO: 74041 - DNA, 15 bp, Artificial Sequence
  dgRNA
  Cog4
aaaatttatacgtta

SEQ ID NO: 74042 - DNA, 15 bp, Artificial Sequence
  dgRNA
  Cog4
ccaatggttttgatc

SEQ ID NO: 74043 - DNA, 15 bp, Artificial Sequence
  dgRNA
  Cog4
gatcgggcatatctg

SEQ ID NO: 74044 - DNA, 15 bp, Artificial Sequence
  dgRNA
  Cog4
atcgggcatatctgt

SEQ ID NO: 74045 - DNA, 15 bp, Artificial Sequence
  dgRNA
  Cdca5
gatgccgatcgtgac

SEQ ID NO: 74046 - DNA, 15 bp, Artificial Sequence
  dgRNA
  Cdca5
cgtgaccggtgcgta

SEQ ID NO: 74047 - DNA, 15 bp, Artificial Sequence
  dgRNA
  Cdca5
cggtaatgaaaagcg

SEQ ID NO: 74048 - DNA, 15 bp, Artificial Sequence
  dgRNA
  Cdca5
aatgaaaagcgcgga

SEQ ID NO: 74049 - DNA, 15 bp, Artificial Sequence
  dgRNA
  Lcn2
tgcacagttccgacc

SEQ ID NO: 74050 - DNA, 15 bp, Artificial Sequence
  dgRNA
  Lcn2
gcacagttccgacct

SEQ ID NO: 74051 - DNA, 15 bp, Artificial Sequence
  dgRNA
  Lcn2
cacagttccgacctg

SEQ ID NO: 74052 - DNA, 15 bp, Artificial Sequence
  dgRNA
  Lcn2
acagttccgacctgg

SEQ ID NO: 74053 - DNA, 15 bp, Artificial Sequence
  dgRNA
  Kif14
ccgacaaggatctga

SEQ ID NO: 74054 - DNA, 15 bp, Artificial Sequence
  dgRNA
  Kif14
cgacaaggatctgaa

SEQ ID NO: 74055 - DNA, 15 bp, Artificial Sequence
  dgRNA
  Kif14
ccttgtcggggtgct

SEQ ID NO: 74056 - DNA, 15 bp, Artificial Sequence
  dgRNA
  Kif14
ttcagatccttgtcg

SEQ ID NO: 74057 - DNA, 15 bp, Artificial Sequence
  dgRNA
  Mier3
accgcacccaccggc

SEQ ID NO: 74058 - DNA, 15 bp, Artificial Sequence
  dgRNA
  Mier3
cgcccgcagttcagc

SEQ ID NO: 74059 - DNA, 15 bp, Artificial Sequence
  dgRNA
  Mier3
gaactttactccagc

SEQ ID NO: 74060 - DNA, 15 bp, Artificial Sequence
  dgRNA
  Mier3
cggggcagagcgccg

SEQ ID NO: 74061 - DNA, 15 bp, Artificial Sequence
  dgRNA
  Simc1
cctgacccgggcgcg

SEQ ID NO: 74062 - DNA, 15 bp, Artificial Sequence
  dgRNA
  Simc1
ggctgcccccgagat

SEQ ID NO: 74063 - DNA, 15 bp, Artificial Sequence
  dgRNA
  Simc1
tgcccccgagatagg

SEQ ID NO: 74064 - DNA, 15 bp, Artificial Sequence
  dgRNA
  Simc1
gcccccgagataggc

SEQ ID NO: 74065 - DNA, 15 bp, Artificial Sequence
  dgRNA
  Tssk6
cagtgacttctcacg

SEQ ID NO: 74066 - DNA, 15 bp, Artificial Sequence
  dgRNA
  Tssk6
aggaactgaccatta

SEQ ID NO: 74067 - DNA, 15 bp, Artificial Sequence
  dgRNA
  Tssk6
ggaactgaccattaa

SEQ ID NO: 74068 - DNA, 15 bp, Artificial Sequence
  dgRNA
  Tssk6
gcctaagaagggttt

SEQ ID NO: 74069 - DNA, 15 bp, Artificial Sequence
  dgRNA
  Nat8
ggttatcaaacacct

SEQ ID NO: 74070 - DNA, 15 bp, Artificial Sequence
  dgRNA
  Nat8
cctaggtgctcgcca

SEQ ID NO: 74071 - DNA, 15 bp, Artificial Sequence
  dgRNA
  Nat8
agttgcactgtccca

SEQ ID NO: 74072 - DNA, 15 bp, Artificial Sequence
  dgRNA
  Nat8
ctaacacgtgcatct

SEQ ID NO: 74073 - DNA, 15 bp, Artificial Sequence
  dgRNA
  Nutm2
ttaaactttacctag

SEQ ID NO: 74074 - DNA, 15 bp, Artificial Sequence
  dgRNA
  Nutm2
tttgaactgacgcca

SEQ ID NO: 74075 - DNA, 15 bp, Artificial Sequence
  dgRNA
  Nutm2
ttacttgccacattc

SEQ ID NO: 74076 - DNA, 15 bp, Artificial Sequence
  dgRNA
  Nutm2
atgatgcacccttct

SEQ ID NO: 74077 - DNA, 15 bp, Artificial Sequence
  dgRNA
  Pdzd11
gcgccctgttccaac

SEQ ID NO: 74078 - DNA, 15 bp, Artificial Sequence
  dgRNA
  Pdzd11
gaggcgccagccaat

SEQ ID NO: 74079 - DNA, 15 bp, Artificial Sequence
  dgRNA
  Pdzd11
acaccgtgacgcgca

SEQ ID NO: 74080 - DNA, 15 bp, Artificial Sequence
  dgRNA
  Pdzd11
ccgtgacgcgcaagg

SEQ ID NO: 74081 - DNA, 15 bp, Artificial Sequence
  dgRNA
  Ftsj3
gccgcccagccgccg

SEQ ID NO: 74082 - DNA, 15 bp, Artificial Sequence
  dgRNA
  Ftsj3
aatccttacctgctc

SEQ ID NO: 74083 - DNA, 15 bp, Artificial Sequence
  dgRNA
  Ftsj3
ctcggcagggatcgc

SEQ ID NO: 74084 - DNA, 15 bp, Artificial Sequence
  dgRNA
  Ftsj3
gtcactctatcgcgc

SEQ ID NO: 74085 - DNA, 15 bp, Artificial Sequence
  dgRNA
  Nkiras2
agaacgaaacgtcac

SEQ ID NO: 74086 - DNA, 15 bp, Artificial Sequence
  dgRNA
  Nkiras2
tgggtatttccccgc

SEQ ID NO: 74087 - DNA, 15 bp, Artificial Sequence
  dgRNA
  Nkiras2
ttccccgccggcctc

SEQ ID NO: 74088 - DNA, 15 bp, Artificial Sequence
  dgRNA
  Nkiras2
tccccgccggcctct

SEQ ID NO: 74089 - DNA, 15 bp, Artificial Sequence
  dgRNA
  Rara
tatccatacccagcc

SEQ ID NO: 74090 - DNA, 15 bp, Artificial Sequence
  dgRNA
  Rara
tctctctcgtagtag

SEQ ID NO: 74091 - DNA, 15 bp, Artificial Sequence
  dgRNA
  Rara
ctctctcgtagtagt

SEQ ID NO: 74092 - DNA, 15 bp, Artificial Sequence
  dgRNA
  Rara
tctctcgtagtagtg

SEQ ID NO: 74093 - DNA, 15 bp, Artificial Sequence
  dgRNA
  Mb21d1
gtttccgcgtctgtg

SEQ ID NO: 74094 - DNA, 15 bp, Artificial Sequence
  dgRNA
  Mb21d1
gcgtctgtgcggtaa

SEQ ID NO: 74095 - DNA, 15 bp, Artificial Sequence
  dgRNA
  Mb21d1
tgtgcggtaaaggag

SEQ ID NO: 74096 - DNA, 15 bp, Artificial Sequence
  dgRNA
  Mb21d1
aggtttcccggccag

SEQ ID NO: 74097 - DNA, 15 bp, Artificial Sequence
  dgRNA
  Cytl1
gtgtcccagacccta

SEQ ID NO: 74098 - DNA, 15 bp, Artificial Sequence
  dgRNA
  Cytl1
tagttccaccctcct

SEQ ID NO: 74099 - DNA, 15 bp, Artificial Sequence
  dgRNA
  Cytl1
cgggtgcatagttgg

SEQ ID NO: 74100 - DNA, 15 bp, Artificial Sequence
  dgRNA
  Cytl1
gcgggtgcatagttg

SEQ ID NO: 74101 - DNA, 15 bp, Artificial Sequence
  dgRNA
  Gpr153
aggcggcgcccaggg

SEQ ID NO: 74102 - DNA, 15 bp, Artificial Sequence
  dgRNA
  Gpr153
ggcggcgcccaggga

SEQ ID NO: 74103 - DNA, 15 bp, Artificial Sequence
  dgRNA
  Gpr153
cgcagcgcagcgctc

SEQ ID NO: 74104 - DNA, 15 bp, Artificial Sequence
  dgRNA
  Gpr153
gcagcgcagcgctct

SEQ ID NO: 74105 - DNA, 15 bp, Artificial Sequence
  dgRNA
  Plxna1
gccatcgccctttga

SEQ ID NO: 74106 - DNA, 15 bp, Artificial Sequence
  dgRNA
  Plxna1
ttgaaggcaagcggt

SEQ ID NO: 74107 - DNA, 15 bp, Artificial Sequence
  dgRNA
  Plxna1
tgaaggcaagcggtg

SEQ ID NO: 74108 - DNA, 15 bp, Artificial Sequence
  dgRNA
  Plxna1
cgcgcgctctcgccg

SEQ ID NO: 74109 - DNA, 15 bp, Artificial Sequence
  dgRNA
  Sema3c
gggagtgtcccggag

SEQ ID NO: 74110 - DNA, 15 bp, Artificial Sequence
  dgRNA
  Sema3c
gtgtcccggagagga

SEQ ID NO: 74111 - DNA, 15 bp, Artificial Sequence
  dgRNA
  Sema3c
ggatatgattcagtg

SEQ ID NO: 74112 - DNA, 15 bp, Artificial Sequence
  dgRNA
  Sema3c
gatttcaggacgtta

SEQ ID NO: 74113 - DNA, 15 bp, Artificial Sequence
  dgRNA
  Slc2a8
ttggacagtcgtgcc

SEQ ID NO: 74114 - DNA, 15 bp, Artificial Sequence
  dgRNA
  Slc2a8
tggacagtcgtgcct

SEQ ID NO: 74115 - DNA, 15 bp, Artificial Sequence
  dgRNA
  Slc2a8
gtcgtgcctgggtcc

SEQ ID NO: 74116 - DNA, 15 bp, Artificial Sequence
  dgRNA
  Slc2a8
ctgcaaacctttact

SEQ ID NO: 74117 - DNA, 15 bp, Artificial Sequence
  dgRNA
  Map3k8
gggcagggatgcccg

SEQ ID NO: 74118 - DNA, 15 bp, Artificial Sequence
  dgRNA
  Map3k8
gagcgtgcctcccac

SEQ ID NO: 74119 - DNA, 15 bp, Artificial Sequence
  dgRNA
  Map3k8
cggtgaacactcgag

SEQ ID NO: 74120 - DNA, 15 bp, Artificial Sequence
  dgRNA
  Map3k8
tggcctgctgcacgc

SEQ ID NO: 74121 - DNA, 15 bp, Artificial Sequence
  dgRNA
  Adam10
cccgggcgctcgcct

SEQ ID NO: 74122 - DNA, 15 bp, Artificial Sequence
  dgRNA
  Adam10
gcatgcgcattatcc

SEQ ID NO: 74123 - DNA, 15 bp, Artificial Sequence
  dgRNA
  Adam10
catgcgcattatccc

SEQ ID NO: 74124 - DNA, 15 bp, Artificial Sequence
  dgRNA
  Adam10
atgcgcattatcccg

SEQ ID NO: 74125 - DNA, 15 bp, Artificial Sequence
  dgRNA
  Asns
gagatctattgctga

SEQ ID NO: 74126 - DNA, 15 bp, Artificial Sequence
  dgRNA
  Asns
agatctattgctgat

SEQ ID NO: 74127 - DNA, 15 bp, Artificial Sequence
  dgRNA
  Asns
atgggacactggacc

SEQ ID NO: 74128 - DNA, 15 bp, Artificial Sequence
  dgRNA
  Asns
tggcggcccgacctc

SEQ ID NO: 74129 - DNA, 15 bp, Artificial Sequence
  dgRNA
  Heatr1
ggttcaggcccttag

SEQ ID NO: 74130 - DNA, 15 bp, Artificial Sequence
  dgRNA
  Heatr1
gttcaggcccttaga

SEQ ID NO: 74131 - DNA, 15 bp, Artificial Sequence
  dgRNA
  Heatr1
ttcaggcccttagag

SEQ ID NO: 74132 - DNA, 15 bp, Artificial Sequence
  dgRNA
  Heatr1
aggcggggaattaaa

SEQ ID NO: 74133 - DNA, 15 bp, Artificial Sequence
  dgRNA
  Narfl
caaccaagggacgca

SEQ ID NO: 74134 - DNA, 15 bp, Artificial Sequence
  dgRNA
  Narfl
aaccaagggacgcaa

SEQ ID NO: 74135 - DNA, 15 bp, Artificial Sequence
  dgRNA
  Narfl
ccgaacgctgtgctg

SEQ ID NO: 74136 - DNA, 15 bp, Artificial Sequence
  dgRNA
  Narfl
gcagcttgagtccgc

SEQ ID NO: 74137 - DNA, 15 bp, Artificial Sequence
  dgRNA
  Higd1c
ccaaagctaacgttg

SEQ ID NO: 74138 - DNA, 15 bp, Artificial Sequence
  dgRNA
  Higd1c
gctaacgttgtggca

SEQ ID NO: 74139 - DNA, 15 bp, Artificial Sequence
  dgRNA
  Higd1c
tagcgggtcttcagc

SEQ ID NO: 74140 - DNA, 15 bp, Artificial Sequence
  dgRNA
  Higd1c
agcgggtcttcagca

SEQ ID NO: 74141 - DNA, 15 bp, Artificial Sequence
  dgRNA
  Enox2
ctagtagaaggtgca

SEQ ID NO: 74142 - DNA, 15 bp, Artificial Sequence
  dgRNA
  Enox2
tagaaggtgcacggt

SEQ ID NO: 74143 - DNA, 15 bp, Artificial Sequence
  dgRNA
  Enox2
agaaggtgcacggtt

SEQ ID NO: 74144 - DNA, 15 bp, Artificial Sequence
  dgRNA
  Enox2
tagatggcctaggcc

SEQ ID NO: 74145 - DNA, 15 bp, Artificial Sequence
  dgRNA
  Setd5
tcccctacctagccg

SEQ ID NO: 74146 - DNA, 15 bp, Artificial Sequence
  dgRNA
  Setd5
ttctttaggcggccc

SEQ ID NO: 74147 - DNA, 15 bp, Artificial Sequence
  dgRNA
  Setd5
gcagcctccgctgat

SEQ ID NO: 74148 - DNA, 15 bp, Artificial Sequence
  dgRNA
  Setd5
gcctccgctgattgg

SEQ ID NO: 74149 - DNA, 15 bp, Artificial Sequence
  dgRNA
  Zfp182
cgcctgcgttgagcc

SEQ ID NO: 74150 - DNA, 15 bp, Artificial Sequence
  dgRNA
  Zfp182
cgccatgttgactat

SEQ ID NO: 74151 - DNA, 15 bp, Artificial Sequence
  dgRNA
  Zfp182
catgttgactattgg

SEQ ID NO: 74152 - DNA, 15 bp, Artificial Sequence
  dgRNA
  Zfp182
cggatgctgtctcaa

SEQ ID NO: 74153 - DNA, 15 bp, Artificial Sequence
  dgRNA
  Olfr1349
actccctttatccca

SEQ ID NO: 74154 - DNA, 15 bp, Artificial Sequence
  dgRNA
  Olfr1349
acgggttaactgaga

SEQ ID NO: 74155 - DNA, 15 bp, Artificial Sequence
  dgRNA
  Olfr1349
aagacctcggttgtc

SEQ ID NO: 74156 - DNA, 15 bp, Artificial Sequence
  dgRNA
  Olfr1349
agacctcggttgtca

SEQ ID NO: 74157 - DNA, 15 bp, Artificial Sequence
  dgRNA
  Capn11
ccaaactccctgcat

SEQ ID NO: 74158 - DNA, 15 bp, Artificial Sequence
  dgRNA
  Capn11
ggacaagcacccaac

SEQ ID NO: 74159 - DNA, 15 bp, Artificial Sequence
  dgRNA
  Capn11
ccttactgggacagg

SEQ ID NO: 74160 - DNA, 15 bp, Artificial Sequence
  dgRNA
  Capn11
gtccttactgggaca

SEQ ID NO: 74161 - DNA, 15 bp, Artificial Sequence
  dgRNA
  Slc25a5
cctgatcaggtgcca

SEQ ID NO: 74162 - DNA, 15 bp, Artificial Sequence
  dgRNA
  Slc25a5
ctgatcaggtgccaa

SEQ ID NO: 74163 - DNA, 15 bp, Artificial Sequence
  dgRNA
  Slc25a5
tgccaagggcaagcg

SEQ ID NO: 74164 - DNA, 15 bp, Artificial Sequence
  dgRNA
  Slc25a5
caagcgaggctgaca

SEQ ID NO: 74165 - DNA, 15 bp, Artificial Sequence
  dgRNA
  Samd10
tagctaaaagcgcac

SEQ ID NO: 74166 - DNA, 15 bp, Artificial Sequence
  dgRNA
  Samd10
accaccaccagaccg

SEQ ID NO: 74167 - DNA, 15 bp, Artificial Sequence
  dgRNA
  Samd10
caccaccagaccgag

SEQ ID NO: 74168 - DNA, 15 bp, Artificial Sequence
  dgRNA
  Samd10
agcgggttgcaagag

SEQ ID NO: 74169 - DNA, 15 bp, Artificial Sequence
  dgRNA
  Cc2d1b
ggggcacgcctaccg

SEQ ID NO: 74170 - DNA, 15 bp, Artificial Sequence
  dgRNA
  Cc2d1b
gggcacgcctaccgt

SEQ ID NO: 74171 - DNA, 15 bp, Artificial Sequence
  dgRNA
  Cc2d1b
gacgctgccgccagc

SEQ ID NO: 74172 - DNA, 15 bp, Artificial Sequence
  dgRNA
  Cc2d1b
atgcctgcgcgcagc

SEQ ID NO: 74173 - DNA, 15 bp, Artificial Sequence
  dgRNA
  Klk1b3
acccaatcgcatccc

SEQ ID NO: 74174 - DNA, 15 bp, Artificial Sequence
  dgRNA
  Klk1b3
cccaatcgcatccct

SEQ ID NO: 74175 - DNA, 15 bp, Artificial Sequence
  dgRNA
  Klk1b3
acagcaggtgcaacg

SEQ ID NO: 74176 - DNA, 15 bp, Artificial Sequence
  dgRNA
  Klk1b3
ggatgcgattgggtg

SEQ ID NO: 74177 - DNA, 15 bp, Artificial Sequence
  dgRNA
  Eif4enif1
actcacggaaggagg

SEQ ID NO: 74178 - DNA, 15 bp, Artificial Sequence
  dgRNA
  Eif4enif1
ggtactcacggaagg

SEQ ID NO: 74179 - DNA, 15 bp, Artificial Sequence
  dgRNA
  Eif4enif1
gacggtactcacgga

SEQ ID NO: 74180 - DNA, 15 bp, Artificial Sequence
  dgRNA
  Eif4enif1
cagggacggtactca

SEQ ID NO: 74181 - DNA, 15 bp, Artificial Sequence
  dgRNA
  Apom
cagtttacattgcaa

SEQ ID NO: 74182 - DNA, 15 bp, Artificial Sequence
  dgRNA
  Apom
ggattagctagttcc

SEQ ID NO: 74183 - DNA, 15 bp, Artificial Sequence
  dgRNA
  Apom
gtcgctagggcatgg

SEQ ID NO: 74184 - DNA, 15 bp, Artificial Sequence
  dgRNA
  Apom
ccagtcgctagggca

SEQ ID NO: 74185 - DNA, 15 bp, Artificial Sequence
  dgRNA
  Med14
ggaaaaagagcgctt

SEQ ID NO: 74186 - DNA, 15 bp, Artificial Sequence
  dgRNA
  Med14
gaaaaagagcgctta

SEQ ID NO: 74187 - DNA, 15 bp, Artificial Sequence
  dgRNA
  Med14
gacgttactgtgacg

SEQ ID NO: 74188 - DNA, 15 bp, Artificial Sequence
  dgRNA
  Med14
ctgtgacgcggccgc

SEQ ID NO: 74189 - DNA, 15 bp, Artificial Sequence
  dgRNA
  Klc3
aagttctcggaacgc

SEQ ID NO: 74190 - DNA, 15 bp, Artificial Sequence
  dgRNA
  Klc3
tttcaccgaatgctg

SEQ ID NO: 74191 - DNA, 15 bp, Artificial Sequence
  dgRNA
  Klc3
cgaatgctgcggcag

SEQ ID NO: 74192 - DNA, 15 bp, Artificial Sequence
  dgRNA
  Klc3
gcctgggcgcctgcg

SEQ ID NO: 74193 - DNA, 15 bp, Artificial Sequence
  dgRNA
  Hnrnph2
agtttaccctcgggg

SEQ ID NO: 74194 - DNA, 15 bp, Artificial Sequence
  dgRNA
  Hnrnph2
attggtccgccccga

SEQ ID NO: 74195 - DNA, 15 bp, Artificial Sequence
  dgRNA
  Hnrnph2
gattggtccgccccg

SEQ ID NO: 74196 - DNA, 15 bp, Artificial Sequence
  dgRNA
  Vstm4
cagtacctaagtttc

SEQ ID NO: 74197 - DNA, 15 bp, Artificial Sequence
  dgRNA
  Vstm4
attgggtttggaaca

SEQ ID NO: 74198 - DNA, 15 bp, Artificial Sequence
  dgRNA
  Vstm4
gttacaacgtcctcc

SEQ ID NO: 74199 - DNA, 15 bp, Artificial Sequence
  dgRNA
  Vstm4
acaacgtgaatctcc

SEQ ID NO: 74200 - DNA, 15 bp, Artificial Sequence
  dgRNA
  Xlr
actgggtaacagggt

SEQ ID NO: 74201 - DNA, 15 bp, Artificial Sequence
  dgRNA
  Pik3ip1
cctcaagcagtatat

SEQ ID NO: 74202 - DNA, 15 bp, Artificial Sequence
  dgRNA
  Pik3ip1
ttatccatatatagt

SEQ ID NO: 74203 - DNA, 15 bp, Artificial Sequence
  dgRNA
  Pik3ip1
ctaacatttgaggtt

SEQ ID NO: 74204 - DNA, 15 bp, Artificial Sequence
  dgRNA
  Cldn23
accatccgggcgggc

SEQ ID NO: 74205 - DNA, 15 bp, Artificial Sequence
  dgRNA
  Cldn23
ccatccgggcgggct

SEQ ID NO: 74206 - DNA, 15 bp, Artificial Sequence
  dgRNA
  Cldn23
tccgggcgggctggg

SEQ ID NO: 74207 - DNA, 15 bp, Artificial Sequence
  dgRNA
  Cldn23
agtggccgggctagg

SEQ ID NO: 74208 - DNA, 15 bp, Artificial Sequence
  dgRNA
  Car4
cctgaagatgcggag

SEQ ID NO: 74209 - DNA, 15 bp, Artificial Sequence
  dgRNA
  Car4
ctgaagatgcggagt

SEQ ID NO: 74210 - DNA, 15 bp, Artificial Sequence
  dgRNA
  Car4
atgcggagtgggtga

SEQ ID NO: 74211 - DNA, 15 bp, Artificial Sequence
  dgRNA
  Car4
ggggtcttttcgcca

SEQ ID NO: 74212 - DNA, 15 bp, Artificial Sequence
  dgRNA
  Tead1
gaagcagtatattga

SEQ ID NO: 74213 - DNA, 15 bp, Artificial Sequence
  dgRNA
  Tead1
acccctagccttaca

SEQ ID NO: 74214 - DNA, 15 bp, Artificial Sequence
  dgRNA
  Tead1
tggccgactgaagct

SEQ ID NO: 74215 - DNA, 15 bp, Artificial Sequence
  dgRNA
  Tead1
atggccgactgaagc

SEQ ID NO: 74216 - DNA, 15 bp, Artificial Sequence
  dgRNA
  Ylpm1
attttccgaacccga

SEQ ID NO: 74217 - DNA, 15 bp, Artificial Sequence
  dgRNA
  Ylpm1
tccgaacccgaagga

SEQ ID NO: 74218 - DNA, 15 bp, Artificial Sequence
  dgRNA
  Ylpm1
cgagtacctgcgcca

SEQ ID NO: 74219 - DNA, 15 bp, Artificial Sequence
  dgRNA
  Ylpm1
ttgttctccgctcga

SEQ ID NO: 74220 - DNA, 15 bp, Artificial Sequence
  dgRNA
  Emc7
tcgccttacatgccc

SEQ ID NO: 74221 - DNA, 15 bp, Artificial Sequence
  dgRNA
  Emc7
cacaacttctctccg

SEQ ID NO: 74222 - DNA, 15 bp, Artificial Sequence
  dgRNA
  Emc7
cttctctccggggcg

SEQ ID NO: 74223 - DNA, 15 bp, Artificial Sequence
  dgRNA
  Emc7
gcgtggacaagctcc

SEQ ID NO: 74224 - DNA, 15 bp, Artificial Sequence
  dgRNA
  Rasa4
cccccgcaggagggg

SEQ ID NO: 74225 - DNA, 15 bp, Artificial Sequence
  dgRNA
  Rasa4
cccgcaggaggggcg

SEQ ID NO: 74226 - DNA, 15 bp, Artificial Sequence
  dgRNA
  Rasa4
cggggagacactgca

SEQ ID NO: 74227 - DNA, 15 bp, Artificial Sequence
  dgRNA
  Rasa4
ccctcctgcgggggc

SEQ ID NO: 74228 - DNA, 15 bp, Artificial Sequence
  dgRNA
  Fitm1
gacacaggctatgtc

SEQ ID NO: 74229 - DNA, 15 bp, Artificial Sequence
  dgRNA
  Fitm1
cgtcagtcctcaaac

SEQ ID NO: 74230 - DNA, 15 bp, Artificial Sequence
  dgRNA
  Fitm1
aaactggccccttgc

SEQ ID NO: 74231 - DNA, 15 bp, Artificial Sequence
  dgRNA
  Fitm1
gcctatccttgtctg

SEQ ID NO: 74232 - DNA, 15 bp, Artificial Sequence
  dgRNA
  Derl2
ctagctgtggccggc

SEQ ID NO: 74233 - DNA, 15 bp, Artificial Sequence
  dgRNA
  Derl2
tagctgtggccggca

SEQ ID NO: 74234 - DNA, 15 bp, Artificial Sequence
  dgRNA
  Derl2
gccggcagggattgg

SEQ ID NO: 74235 - DNA, 15 bp, Artificial Sequence
  dgRNA
  Derl2
gcagggattggcgga

SEQ ID NO: 74236 - DNA, 15 bp, Artificial Sequence
  dgRNA
  Sprr2d
ttgttcctactaggc

SEQ ID NO: 74237 - DNA, 15 bp, Artificial Sequence
  dgRNA
  Sprr2d
gcttgtcgtataaat

SEQ ID NO: 74238 - DNA, 15 bp, Artificial Sequence
  dgRNA
  Sprr2d
tatgactggcttgac

SEQ ID NO: 74239 - DNA, 15 bp, Artificial Sequence
  dgRNA
  Sprr2d
aaatgcatgtatgac

SEQ ID NO: 74240 - DNA, 15 bp, Artificial Sequence
  dgRNA
  Cth
ctgaggtgtcccacg

SEQ ID NO: 74241 - DNA, 15 bp, Artificial Sequence
  dgRNA
  Cth
tgaggtgtcccacgt

SEQ ID NO: 74242 - DNA, 15 bp, Artificial Sequence
  dgRNA
  Cth
cggggcaggaacgat

SEQ ID NO: 74243 - DNA, 15 bp, Artificial Sequence
  dgRNA
  Cth
ggggcaggaacgatc

SEQ ID NO: 74244 - DNA, 15 bp, Artificial Sequence
  dgRNA
  Nmt1
aacgttagccgataa

SEQ ID NO: 74245 - DNA, 15 bp, Artificial Sequence
  dgRNA
  Nmt1
ataacggctcatctg

SEQ ID NO: 74246 - DNA, 15 bp, Artificial Sequence
  dgRNA
  Nmt1
gcctgttgattacca

SEQ ID NO: 74247 - DNA, 15 bp, Artificial Sequence
  dgRNA
  Nmt1
gttgattaccaaggg

SEQ ID NO: 74248 - DNA, 15 bp, Artificial Sequence
  dgRNA
  Cdc42bpg
cgctaggctctgtct

SEQ ID NO: 74249 - DNA, 15 bp, Artificial Sequence
  dgRNA
  Cdc42bpg
ggttagtgtctcatg

SEQ ID NO: 74250 - DNA, 15 bp, Artificial Sequence
  dgRNA
  Cdc42bpg
gttagtgtctcatga

SEQ ID NO: 74251 - DNA, 15 bp, Artificial Sequence
  dgRNA
  Cdc42bpg
gtctcatgagggtct

SEQ ID NO: 74252 - DNA, 15 bp, Artificial Sequence
  dgRNA
  Romo1
ctcccgaaaacaaat

SEQ ID NO: 74253 - DNA, 15 bp, Artificial Sequence
  dgRNA
  Romo1
aacaaataggagacc

SEQ ID NO: 74254 - DNA, 15 bp, Artificial Sequence
  dgRNA
  Romo1
taggagaccgggcga

SEQ ID NO: 74255 - DNA, 15 bp, Artificial Sequence
  dgRNA
  Romo1
aggagaccgggcgac

SEQ ID NO: 74256 - DNA, 15 bp, Artificial Sequence
  dgRNA
  Nt5dc2
tagccacaagcactc

SEQ ID NO: 74257 - DNA, 15 bp, Artificial Sequence
  dgRNA
  Nt5dc2
ccgtaactgagacaa

SEQ ID NO: 74258 - DNA, 15 bp, Artificial Sequence
  dgRNA
  Nt5dc2
tgacgtcgaagtcta

SEQ ID NO: 74259 - DNA, 15 bp, Artificial Sequence
  dgRNA
  Nt5dc2
cggcccgagtgcttg

SEQ ID NO: 74260 - DNA, 15 bp, Artificial Sequence
  dgRNA
  Wsb2
tccgtccccacagct

SEQ ID NO: 74261 - DNA, 15 bp, Artificial Sequence
  dgRNA
  Wsb2
tctccgccccggccc

SEQ ID NO: 74262 - DNA, 15 bp, Artificial Sequence
  dgRNA
  Wsb2
ggacgcggagcccgg

SEQ ID NO: 74263 - DNA, 15 bp, Artificial Sequence
  dgRNA
  Wsb2
aagggacgcggagcc

SEQ ID NO: 74264 - DNA, 15 bp, Artificial Sequence
  dgRNA
  Sult2a8
tgctcaatagtttaa

SEQ ID NO: 74265 - DNA, 15 bp, Artificial Sequence
  dgRNA
  Sult2a8
acatttgatcaattc

SEQ ID NO: 74266 - DNA, 15 bp, Artificial Sequence
  dgRNA
  Sult2a8
tgatcaattctggtt

SEQ ID NO: 74267 - DNA, 15 bp, Artificial Sequence
  dgRNA
  Sult2a8
tcaataggcaaagtt

SEQ ID NO: 74268 - DNA, 15 bp, Artificial Sequence
  dgRNA
  Ifnar2
ccgcatcactaggcc

SEQ ID NO: 74269 - DNA, 15 bp, Artificial Sequence
  dgRNA
  Ifnar2
cctggcctagtgatg

SEQ ID NO: 74270 - DNA, 15 bp, Artificial Sequence
  dgRNA
  Cav3
gtgccaaggtcactc

SEQ ID NO: 74271 - DNA, 15 bp, Artificial Sequence
  dgRNA
  Cav3
agagcggcaaattcc

SEQ ID NO: 74272 - DNA, 15 bp, Artificial Sequence
  dgRNA
  Cav3
gagcggcaaattcca

SEQ ID NO: 74273 - DNA, 15 bp, Artificial Sequence
  dgRNA
  Cav3
accccttggagtccc

SEQ ID NO: 74274 - DNA, 15 bp, Artificial Sequence
  dgRNA
  Fam122b
aatgggcggaggctt

SEQ ID NO: 74275 - DNA, 15 bp, Artificial Sequence
  dgRNA
  Fam122b
ggggctaatgggcgg

SEQ ID NO: 74276 - DNA, 15 bp, Artificial Sequence
  dgRNA
  Fam122b
gcgggggctaatggg

SEQ ID NO: 74277 - DNA, 15 bp, Artificial Sequence
  dgRNA
  Fam122b
ggggcgggggctaat

SEQ ID NO: 74278 - DNA, 15 bp, Artificial Sequence
  dgRNA
  Il33
ggggaatctgtctcc

SEQ ID NO: 74279 - DNA, 15 bp, Artificial Sequence
  dgRNA
  Il33
gatatacttaattac

SEQ ID NO: 74280 - DNA, 15 bp, Artificial Sequence
  dgRNA
  Il33
atggagcgatatgaa

SEQ ID NO: 74281 - DNA, 15 bp, Artificial Sequence
  dgRNA
  Capn9
ctctaaagttgactc

SEQ ID NO: 74282 - DNA, 15 bp, Artificial Sequence
  dgRNA
  Capn9
ttgactccggttcct

SEQ ID NO: 74283 - DNA, 15 bp, Artificial Sequence
  dgRNA
  Capn9
tcagtatttgccatc

SEQ ID NO: 74284 - DNA, 15 bp, Artificial Sequence
  dgRNA
  Capn9
cagtatttgccatcc

SEQ ID NO: 74285 - DNA, 15 bp, Artificial Sequence
  dgRNA
  Foxo1
aataataacggagat

SEQ ID NO: 74286 - DNA, 15 bp, Artificial Sequence
  dgRNA
  Foxo1
tactgccgcctcccg

SEQ ID NO: 74287 - DNA, 15 bp, Artificial Sequence
  dgRNA
  Foxo1
actgccgcctcccga

SEQ ID NO: 74288 - DNA, 15 bp, Artificial Sequence
  dgRNA
  Foxo1
caggcccgcgttcat

SEQ ID NO: 74289 - DNA, 15 bp, Artificial Sequence
  dgRNA
  Calcr
gtgttagtcacctcg

SEQ ID NO: 74290 - DNA, 15 bp, Artificial Sequence
  dgRNA
  Calcr
tgttagtcacctcga

SEQ ID NO: 74291 - DNA, 15 bp, Artificial Sequence
  dgRNA
  Calcr
attcccgggatacac

SEQ ID NO: 74292 - DNA, 15 bp, Artificial Sequence
  dgRNA
  Calcr
gagtttgggtagttc

SEQ ID NO: 74293 - DNA, 15 bp, Artificial Sequence
  dgRNA
  Actr1b
ccgcgcagcctacct

SEQ ID NO: 74294 - DNA, 15 bp, Artificial Sequence
  dgRNA
  Actr1b
taccttggcaacgcc

SEQ ID NO: 74295 - DNA, 15 bp, Artificial Sequence
  dgRNA
  Actr1b
ccggaaagcttcaat

SEQ ID NO: 74296 - DNA, 15 bp, Artificial Sequence
  dgRNA
  Actr1b
cttcaattggttagc

SEQ ID NO: 74297 - DNA, 15 bp, Artificial Sequence
  dgRNA
  Olfr803
atgttagatgaaacc

SEQ ID NO: 74298 - DNA, 15 bp, Artificial Sequence
  dgRNA
  Foxd1
gttcacccgcaggag

SEQ ID NO: 74299 - DNA, 15 bp, Artificial Sequence
  dgRNA
  Foxd1
agttcacccgcagga

SEQ ID NO: 74300 - DNA, 15 bp, Artificial Sequence
  dgRNA
  Foxd1
aagttcacccgcagg

SEQ ID NO: 74301 - DNA, 15 bp, Artificial Sequence
  dgRNA
  Foxd1
agaaagttcacccgc

SEQ ID NO: 74302 - DNA, 15 bp, Artificial Sequence
  dgRNA
  Prkacb
cgagcttagcctccg

SEQ ID NO: 74303 - DNA, 15 bp, Artificial Sequence
  dgRNA
  Prkacb
ggggctcccgcccgc

SEQ ID NO: 74304 - DNA, 15 bp, Artificial Sequence
  dgRNA
  Prkacb
gggctcccgcccgcc

SEQ ID NO: 74305 - DNA, 15 bp, Artificial Sequence
  dgRNA
  Prkacb
ggctcccgcccgccg

SEQ ID NO: 74306 - DNA, 15 bp, Artificial Sequence
  dgRNA
  Tpsg1
cctgtggtgtgcaat

SEQ ID NO: 74307 - DNA, 15 bp, Artificial Sequence
  dgRNA
  Tpsg1
gtgtgcaataggatc

SEQ ID NO: 74308 - DNA, 15 bp, Artificial Sequence
  dgRNA
  Tpsg1
caataggatcaggtg

SEQ ID NO: 74309 - DNA, 15 bp, Artificial Sequence
  dgRNA
  Tpsg1
ggctacacccaacct

SEQ ID NO: 74310 - DNA, 15 bp, Artificial Sequence
  dgRNA
  Rai1
ccgggctgcaccttc

SEQ ID NO: 74311 - DNA, 15 bp, Artificial Sequence
  dgRNA
  Rai1
acatggggcgtgcag

SEQ ID NO: 74312 - DNA, 15 bp, Artificial Sequence
  dgRNA
  Rai1
catggggcgtgcagt

SEQ ID NO: 74313 - DNA, 15 bp, Artificial Sequence
  dgRNA
  Rai1
gtgcagtggggcgcg

SEQ ID NO: 74314 - DNA, 15 bp, Artificial Sequence
  dgRNA
  F11r
taagcgacagtctcc

SEQ ID NO: 74315 - DNA, 15 bp, Artificial Sequence
  dgRNA
  F11r
aagcgacagtctcct

SEQ ID NO: 74316 - DNA, 15 bp, Artificial Sequence
  dgRNA
  F11r
gtgaaagccaccaat

SEQ ID NO: 74317 - DNA, 15 bp, Artificial Sequence
  dgRNA
  F11r
caatcggactcaaga

SEQ ID NO: 74318 - DNA, 15 bp, Artificial Sequence
  dgRNA
  Rbmx
agctaaaaggcgcct

SEQ ID NO: 74319 - DNA, 15 bp, Artificial Sequence
  dgRNA
  Rbmx
taaaaggcgccttgg

SEQ ID NO: 74320 - DNA, 15 bp, Artificial Sequence
  dgRNA
  Rbmx
cgccttggaggagaa

SEQ ID NO: 74321 - DNA, 15 bp, Artificial Sequence
  dgRNA
  Rbmx
caaacggttaaaatc

SEQ ID NO: 74322 - DNA, 15 bp, Artificial Sequence
  dgRNA
  Homez
gcagacgccgagtcc

SEQ ID NO: 74323 - DNA, 15 bp, Artificial Sequence
  dgRNA
  Homez
cgcgcctacactgac

SEQ ID NO: 74324 - DNA, 15 bp, Artificial Sequence
  dgRNA
  Homez
atcgcggacctctgc

SEQ ID NO: 74325 - DNA, 15 bp, Artificial Sequence
  dgRNA
  Homez
tcgcggacctctgct

SEQ ID NO: 74326 - DNA, 15 bp, Artificial Sequence
  dgRNA
  Mios
ggcggagcgctcgag

SEQ ID NO: 74327 - DNA, 15 bp, Artificial Sequence
  dgRNA
  Mios
gcggagcgctcgaga

SEQ ID NO: 74328 - DNA, 15 bp, Artificial Sequence
  dgRNA
  Mios
gagcgctcgagaggg

SEQ ID NO: 74329 - DNA, 15 bp, Artificial Sequence
  dgRNA
  Mios
cgctcgagagggagg

SEQ ID NO: 74330 - DNA, 15 bp, Artificial Sequence
  dgRNA
  Srprb
aatacactcgctaac

SEQ ID NO: 74331 - DNA, 15 bp, Artificial Sequence
  dgRNA
  Srprb
atacactcgctaact

SEQ ID NO: 74332 - DNA, 15 bp, Artificial Sequence
  dgRNA
  Srprb
gccgagataccccta

SEQ ID NO: 74333 - DNA, 15 bp, Artificial Sequence
  dgRNA
  Srprb
cgagtgtattcatat

SEQ ID NO: 74334 - DNA, 15 bp, Artificial Sequence
  dgRNA
  Cers2
gtagcattcaacccg

SEQ ID NO: 74335 - DNA, 15 bp, Artificial Sequence
  dgRNA
  Cers2
tagcattcaacccgg

SEQ ID NO: 74336 - DNA, 15 bp, Artificial Sequence
  dgRNA
  Cers2
cccgggggtaaatca

SEQ ID NO: 74337 - DNA, 15 bp, Artificial Sequence
  dgRNA
  Cers2
ccgggggtaaatcat

SEQ ID NO: 74338 - DNA, 15 bp, Artificial Sequence
  dgRNA
  Zdhhc18
cgctgcggagcgagc

SEQ ID NO: 74339 - DNA, 15 bp, Artificial Sequence
  dgRNA
  Zdhhc18
gctgcggagcgagcc

SEQ ID NO: 74340 - DNA, 15 bp, Artificial Sequence
  dgRNA
  Zdhhc18
ctgcggagcgagccg

SEQ ID NO: 74341 - DNA, 15 bp, Artificial Sequence
  dgRNA
  Zdhhc18
tgcggagcgagccgg

SEQ ID NO: 74342 - DNA, 15 bp, Artificial Sequence
  dgRNA
  Nlrp4b
aataccaggccctgt

SEQ ID NO: 74343 - DNA, 15 bp, Artificial Sequence
  dgRNA
  Nlrp4b
ggttatgtagacttc

SEQ ID NO: 74344 - DNA, 15 bp, Artificial Sequence
  dgRNA
  Nlrp4b
taaacccacagggcc

SEQ ID NO: 74345 - DNA, 15 bp, Artificial Sequence
  dgRNA
  Nlrp4b
actccttctcattgg

SEQ ID NO: 74346 - DNA, 15 bp, Artificial Sequence
  dgRNA
  Hspg2
ggacgcgttgcctcg

SEQ ID NO: 74347 - DNA, 15 bp, Artificial Sequence
  dgRNA
  Hspg2
gacgcgttgcctcgg

SEQ ID NO: 74348 - DNA, 15 bp, Artificial Sequence
  dgRNA
  Hspg2
gcgttgcctcggggg

SEQ ID NO: 74349 - DNA, 15 bp, Artificial Sequence
  dgRNA
  Hspg2
ctcgggggcggaacc

SEQ ID NO: 74350 - DNA, 15 bp, Artificial Sequence
  dgRNA
  Defb20
gtaggtgggaaacgt

SEQ ID NO: 74351 - DNA, 15 bp, Artificial Sequence
  dgRNA
  Defb20
ccagacttggaatgc

SEQ ID NO: 74352 - DNA, 15 bp, Artificial Sequence
  dgRNA
  Defb20
gttaactaaactccc

SEQ ID NO: 74353 - DNA, 15 bp, Artificial Sequence
  dgRNA
  Defb20
cagcccacttgggtc

SEQ ID NO: 74354 - DNA, 15 bp, Artificial Sequence
  dgRNA
  Xlr3b
tgcgcgtgtgcaagc

SEQ ID NO: 74355 - DNA, 15 bp, Artificial Sequence
  dgRNA
  Xlr3b
caaggcccgaccaag

SEQ ID NO: 74356 - DNA, 15 bp, Artificial Sequence
  dgRNA
  Xlr3b
aaggcccgaccaagt

SEQ ID NO: 74357 - DNA, 15 bp, Artificial Sequence
  dgRNA
  Xlr3b
ttgcacacgcgcact

SEQ ID NO: 74358 - DNA, 15 bp, Artificial Sequence
  dgRNA
  Kansl3
tggcaccgttctgtt

SEQ ID NO: 74359 - DNA, 15 bp, Artificial Sequence
  dgRNA
  Kansl3
cgttctgtttggtgg

SEQ ID NO: 74360 - DNA, 15 bp, Artificial Sequence
  dgRNA
  Kansl3
tttgatagtgaaagt

SEQ ID NO: 74361 - DNA, 15 bp, Artificial Sequence
  dgRNA
  Kansl3
ttgatagtgaaagtt

SEQ ID NO: 74362 - DNA, 15 bp, Artificial Sequence
  dgRNA
  Pin1rt1
tactagcaccatctg

SEQ ID NO: 74363 - DNA, 15 bp, Artificial Sequence
  dgRNA
  Pin1rt1
tgccatgcctagatc

SEQ ID NO: 74364 - DNA, 15 bp, Artificial Sequence
  dgRNA
  Pin1rt1
taagtaaacgaaagc

SEQ ID NO: 74365 - DNA, 15 bp, Artificial Sequence
  dgRNA
  Pex13
cctgaccacacgcct

SEQ ID NO: 74366 - DNA, 15 bp, Artificial Sequence
  dgRNA
  Pex13
tgccgagtccgtcgg

SEQ ID NO: 74367 - DNA, 15 bp, Artificial Sequence
  dgRNA
  Pex13
aggtgccgagtccgt

SEQ ID NO: 74368 - DNA, 15 bp, Artificial Sequence
  dgRNA
  Pex13
gctcatcgacgtttc

SEQ ID NO: 74369 - DNA, 15 bp, Artificial Sequence
  dgRNA
  Susd4
agagccgctgaatcc

SEQ ID NO: 74370 - DNA, 15 bp, Artificial Sequence
  dgRNA
  Susd4
gagccgctgaatccc

SEQ ID NO: 74371 - DNA, 15 bp, Artificial Sequence
  dgRNA
  Susd4
agccgctgaatcccg

SEQ ID NO: 74372 - DNA, 15 bp, Artificial Sequence
  dgRNA
  Susd4
acgcgcagtatccca

SEQ ID NO: 74373 - DNA, 15 bp, Artificial Sequence
  dgRNA
  Nrg3
gggcgcggcgcaccg

SEQ ID NO: 74374 - DNA, 15 bp, Artificial Sequence
  dgRNA
  Nrg3
gcgcaccgaggatgc

SEQ ID NO: 74375 - DNA, 15 bp, Artificial Sequence
  dgRNA
  Nrg3
ccgaggatgccggcg

SEQ ID NO: 74376 - DNA, 15 bp, Artificial Sequence
  dgRNA
  Nrg3
ggctggagcgcacac

SEQ ID NO: 74377 - DNA, 15 bp, Artificial Sequence
  dgRNA
  Pcnxl3
cctgttcgactactc

SEQ ID NO: 74378 - DNA, 15 bp, Artificial Sequence
  dgRNA
  Pcnxl3
ggctaagctctgacc

SEQ ID NO: 74379 - DNA, 15 bp, Artificial Sequence
  dgRNA
  Pcnxl3
ctgacccggaagtag

SEQ ID NO: 74380 - DNA, 15 bp, Artificial Sequence
  dgRNA
  Pcnxl3
gacaaccatgattta

SEQ ID NO: 74381 - DNA, 15 bp, Artificial Sequence
  dgRNA
  Msrb2
attccaatcggagta

SEQ ID NO: 74382 - DNA, 15 bp, Artificial Sequence
  dgRNA
  Msrb2
cggagtaaggtactg

SEQ ID NO: 74383 - DNA, 15 bp, Artificial Sequence
  dgRNA
  Msrb2
ggagtaaggtactgc

SEQ ID NO: 74384 - DNA, 15 bp, Artificial Sequence
  dgRNA
  Msrb2
gtaaggtactgcggg

SEQ ID NO: 74385 - DNA, 15 bp, Artificial Sequence
  dgRNA
  S1pr4
agcacctgttatgca

SEQ ID NO: 74386 - DNA, 15 bp, Artificial Sequence
  dgRNA
  S1pr4
gcacctgttatgcat

SEQ ID NO: 74387 - DNA, 15 bp, Artificial Sequence
  dgRNA
  S1pr4
cctgttatgcatggg

SEQ ID NO: 74388 - DNA, 15 bp, Artificial Sequence
  dgRNA
  S1pr4
ggtacttgatgtgtt

SEQ ID NO: 74389 - DNA, 15 bp, Artificial Sequence
  dgRNA
  Rgs21
aggcccaatagtcag

SEQ ID NO: 74390 - DNA, 15 bp, Artificial Sequence
  dgRNA
  Rgs21
gatgatagattcagt

SEQ ID NO: 74391 - DNA, 15 bp, Artificial Sequence
  dgRNA
  Rgs21
agactcactactgtc

SEQ ID NO: 74392 - DNA, 15 bp, Artificial Sequence
  dgRNA
  Rgs21
ttatagactgggtac

SEQ ID NO: 74393 - DNA, 15 bp, Artificial Sequence
  dgRNA
  Pitx3
ctaaaggttcacagc

SEQ ID NO: 74394 - DNA, 15 bp, Artificial Sequence
  dgRNA
  Pitx3
caagggcggcgcatc

SEQ ID NO: 74395 - DNA, 15 bp, Artificial Sequence
  dgRNA
  Pitx3
gcggcgcatctggaa

SEQ ID NO: 74396 - DNA, 15 bp, Artificial Sequence
  dgRNA
  Pitx3
cggcgcatctggaaa

SEQ ID NO: 74397 - DNA, 15 bp, Artificial Sequence
  dgRNA
  Ins1
gaaggtctcaccttc

SEQ ID NO: 74398 - DNA, 15 bp, Artificial Sequence
  dgRNA
  Ins1
gacaatgtcccctgc

SEQ ID NO: 74399 - DNA, 15 bp, Artificial Sequence
  dgRNA
  Ins1
acaatgtcccctgct

SEQ ID NO: 74400 - DNA, 15 bp, Artificial Sequence
  dgRNA
  Ins1
gggaactggttcatc

SEQ ID NO: 74401 - DNA, 15 bp, Artificial Sequence
  dgRNA
  Rpp25l
caaatctgcgttctt

SEQ ID NO: 74402 - DNA, 15 bp, Artificial Sequence
  dgRNA
  Rpp25l
aaatctgcgttcttc

SEQ ID NO: 74403 - DNA, 15 bp, Artificial Sequence
  dgRNA
  Rpp25l
tagccgttcctttcc

SEQ ID NO: 74404 - DNA, 15 bp, Artificial Sequence
  dgRNA
  Rpp25l
cgttcctttcccggg

SEQ ID NO: 74405 - DNA, 15 bp, Artificial Sequence
  dgRNA
  Tmem238
tcactatggacttgg

SEQ ID NO: 74406 - DNA, 15 bp, Artificial Sequence
  dgRNA
  Tmem238
gtacaggtagccctc

SEQ ID NO: 74407 - DNA, 15 bp, Artificial Sequence
  dgRNA
  Tmem238
gtagccctcgggaga

SEQ ID NO: 74408 - DNA, 15 bp, Artificial Sequence
  dgRNA
  Tmem238
ttggccctagtcatc

SEQ ID NO: 74409 - DNA, 15 bp, Artificial Sequence
  dgRNA
  Zfp850
ctccgttttgatccc

SEQ ID NO: 74410 - DNA, 15 bp, Artificial Sequence
  dgRNA
  Zfp850
cgttttgatcccagg

SEQ ID NO: 74411 - DNA, 15 bp, Artificial Sequence
  dgRNA
  Zfp850
cctcccctcgaagca

SEQ ID NO: 74412 - DNA, 15 bp, Artificial Sequence
  dgRNA
  Zfp850
ctcccctcgaagcat

SEQ ID NO: 74413 - DNA, 15 bp, Artificial Sequence
  dgRNA
  Aldh6a1
caatcacctattccc

SEQ ID NO: 74414 - DNA, 15 bp, Artificial Sequence
  dgRNA
  Aldh6a1
aatcacctattccca

SEQ ID NO: 74415 - DNA, 15 bp, Artificial Sequence
  dgRNA
  Aldh6a1
atcacctattcccag

SEQ ID NO: 74416 - DNA, 15 bp, Artificial Sequence
  dgRNA
  Aldh6a1
acctattcccagggg

SEQ ID NO: 74417 - DNA, 15 bp, Artificial Sequence
  dgRNA
  Ube2g2
ctgcgcaaagcctca

SEQ ID NO: 74418 - DNA, 15 bp, Artificial Sequence
  dgRNA
  Ube2g2
cgcaaagcctcacgg

SEQ ID NO: 74419 - DNA, 15 bp, Artificial Sequence
  dgRNA
  Ube2g2
gcctcacggcggcgt

SEQ ID NO: 74420 - DNA, 15 bp, Artificial Sequence
  dgRNA
  Ube2g2
cggccgagaagattc

SEQ ID NO: 74421 - DNA, 15 bp, Artificial Sequence
  dgRNA
  Depdc5
ctcggggcggagcct

SEQ ID NO: 74422 - DNA, 15 bp, Artificial Sequence
  dgRNA
  Depdc5
tcggggcggagcctc

SEQ ID NO: 74423 - DNA, 15 bp, Artificial Sequence
  dgRNA
  Vwa1
agatcagcaactgcg

SEQ ID NO: 74424 - DNA, 15 bp, Artificial Sequence
  dgRNA
  Vwa1
gcaactgcggggtgc

SEQ ID NO: 74425 - DNA, 15 bp, Artificial Sequence
  dgRNA
  Vwa1
caactgcggggtgcg

SEQ ID NO: 74426 - DNA, 15 bp, Artificial Sequence
  dgRNA
  Vwa1
aaccctaaggagtag

SEQ ID NO: 74427 - DNA, 15 bp, Artificial Sequence
  dgRNA
  Klhl10
aaggctcaattgtgt

SEQ ID NO: 74428 - DNA, 15 bp, Artificial Sequence
  dgRNA
  Klhl10
gctcaattgtgttgg

SEQ ID NO: 74429 - DNA, 15 bp, Artificial Sequence
  dgRNA
  Klhl10
ctaggtctgaggtcg

SEQ ID NO: 74430 - DNA, 15 bp, Artificial Sequence
  dgRNA
  Klhl10
tcgacctcagaccta

SEQ ID NO: 74431 - DNA, 15 bp, Artificial Sequence
  dgRNA
  Arfgap1
gcgcctagtccagct

SEQ ID NO: 74432 - DNA, 15 bp, Artificial Sequence
  dgRNA
  Prl5a1
ctacagtaatgttga

SEQ ID NO: 74433 - DNA, 15 bp, Artificial Sequence
  dgRNA
  Prl5a1
tacagtaatgttgat

SEQ ID NO: 74434 - DNA, 15 bp, Artificial Sequence
  dgRNA
  Prl5a1
gttaacattccctga

SEQ ID NO: 74435 - DNA, 15 bp, Artificial Sequence
  dgRNA
  Prl5a1
ttaacattccctgag

SEQ ID NO: 74436 - DNA, 15 bp, Artificial Sequence
  dgRNA
  Zfp869
acgctgctccttctt

SEQ ID NO: 74437 - DNA, 15 bp, Artificial Sequence
  dgRNA
  Nlrc5
gattctagattcggt

SEQ ID NO: 74438 - DNA, 15 bp, Artificial Sequence
  dgRNA
  Nlrc5
gattcggttggcatt

SEQ ID NO: 74439 - DNA, 15 bp, Artificial Sequence
  dgRNA
  Nlrc5
gttggcattcggcta

SEQ ID NO: 74440 - DNA, 15 bp, Artificial Sequence
  dgRNA
  Nlrc5
gggtaagtggccttg

SEQ ID NO: 74441 - DNA, 15 bp, Artificial Sequence
  dgRNA
  Hook2
taaagagaagccgcg

SEQ ID NO: 74442 - DNA, 15 bp, Artificial Sequence
  dgRNA
  Hook2
agaagccgcgaggag

SEQ ID NO: 74443 - DNA, 15 bp, Artificial Sequence
  dgRNA
  Hook2
agccgcgaggagtgg

SEQ ID NO: 74444 - DNA, 15 bp, Artificial Sequence
  dgRNA
  Hook2
gtcccgcatctaaga

SEQ ID NO: 74445 - DNA, 15 bp, Artificial Sequence
  dgRNA
  Tmprss2
aagacccgtcgcagc

SEQ ID NO: 74446 - DNA, 15 bp, Artificial Sequence
  dgRNA
  Tmprss2
gtcgcagcaggaccc

SEQ ID NO: 74447 - DNA, 15 bp, Artificial Sequence
  dgRNA
  Tmprss2
gcctcaagggtccgc

SEQ ID NO: 74448 - DNA, 15 bp, Artificial Sequence
  dgRNA
  Tmprss2
aagggtccgctggtc

SEQ ID NO: 74449 - DNA, 15 bp, Artificial Sequence
  dgRNA
  Gstm6
gctcagacccgcctt

SEQ ID NO: 74450 - DNA, 15 bp, Artificial Sequence
  dgRNA
  Gstm6
tcggatgatagctcc

SEQ ID NO: 74451 - DNA, 15 bp, Artificial Sequence
  dgRNA
  Gstm6
ctcctggaattagat

SEQ ID NO: 74452 - DNA, 15 bp, Artificial Sequence
  dgRNA
  Gstm6
cttgttacagtgggt

SEQ ID NO: 74453 - DNA, 15 bp, Artificial Sequence
  dgRNA
  Fga
tgattaacctcctgc

SEQ ID NO: 74454 - DNA, 15 bp, Artificial Sequence
  dgRNA
  Fga
cctgccggtttaagt

SEQ ID NO: 74455 - DNA, 15 bp, Artificial Sequence
  dgRNA
  Fga
ctgccggtttaagta

SEQ ID NO: 74456 - DNA, 15 bp, Artificial Sequence
  dgRNA
  Fga
cggtttaagtagggt

SEQ ID NO: 74457 - DNA, 15 bp, Artificial Sequence
  dgRNA
  Cul7
tactaccttttcact

SEQ ID NO: 74458 - DNA, 15 bp, Artificial Sequence
  dgRNA
  Cul7
gggcgcggtacagaa

SEQ ID NO: 74459 - DNA, 15 bp, Artificial Sequence
  dgRNA
  Cul7
gatggaaaaacggat

SEQ ID NO: 74460 - DNA, 15 bp, Artificial Sequence
  dgRNA
  Cul7
atggaaaaacggatg

SEQ ID NO: 74461 - DNA, 15 bp, Artificial Sequence
  dgRNA
  Efna5
tccccgatctctccc

SEQ ID NO: 74462 - DNA, 15 bp, Artificial Sequence
  dgRNA
  Efna5
gatctctccccggag

SEQ ID NO: 74463 - DNA, 15 bp, Artificial Sequence
  dgRNA
  Efna5
cccggagtggcgcgt

SEQ ID NO: 74464 - DNA, 15 bp, Artificial Sequence
  dgRNA
  Efna5
ccggagtggcgcgtc

SEQ ID NO: 74465 - DNA, 15 bp, Artificial Sequence
  dgRNA
  Csgalnact2
taggcgtgtcctagc

SEQ ID NO: 74466 - DNA, 15 bp, Artificial Sequence
  dgRNA
  Csgalnact2
cgggacttggcagtg

SEQ ID NO: 74467 - DNA, 15 bp, Artificial Sequence
  dgRNA
  Csgalnact2
gagcccggctgcggt

SEQ ID NO: 74468 - DNA, 15 bp, Artificial Sequence
  dgRNA
  Csgalnact2
gcggtgggctgggtc

SEQ ID NO: 74469 - DNA, 15 bp, Artificial Sequence
  dgRNA
  Aig1
cggggatgccgggtc

SEQ ID NO: 74470 - DNA, 15 bp, Artificial Sequence
  dgRNA
  Aig1
atgccgggtccggac

SEQ ID NO: 74471 - DNA, 15 bp, Artificial Sequence
  dgRNA
  Aig1
gggtccggaccggtt

SEQ ID NO: 74472 - DNA, 15 bp, Artificial Sequence
  dgRNA
  Aig1
cggaccggttcggtc

SEQ ID NO: 74473 - DNA, 15 bp, Artificial Sequence
  dgRNA
  Gbp10
tcaaccccccagcct

SEQ ID NO: 74474 - DNA, 15 bp, Artificial Sequence
  dgRNA
  Gbp10
tggctaagttaccat

SEQ ID NO: 74475 - DNA, 15 bp, Artificial Sequence
  dgRNA
  Gbp10
aacttagccaaggct

SEQ ID NO: 74476 - DNA, 15 bp, Artificial Sequence
  dgRNA
  Gbp10
taacttagccaaggc

SEQ ID NO: 74477 - DNA, 15 bp, Artificial Sequence
  dgRNA
  Ptpra
cgcttctcctcgcca

SEQ ID NO: 74478 - DNA, 15 bp, Artificial Sequence
  dgRNA
  Ptpra
ttctcctcgccatgg

SEQ ID NO: 74479 - DNA, 15 bp, Artificial Sequence
  dgRNA
  Ptpra
ctcgccatggaggcg

SEQ ID NO: 74480 - DNA, 15 bp, Artificial Sequence
  dgRNA
  Ptpra
cggggcttcgagcag

SEQ ID NO: 74481 - DNA, 15 bp, Artificial Sequence
  dgRNA
  Etv1
tggactccgggtcaa

SEQ ID NO: 74482 - DNA, 15 bp, Artificial Sequence
  dgRNA
  Etv1
tacgacagtgcttta

SEQ ID NO: 74483 - DNA, 15 bp, Artificial Sequence
  dgRNA
  Etv1
ggaccaaacaacgct

SEQ ID NO: 74484 - DNA, 15 bp, Artificial Sequence
  dgRNA
  Etv1
ttgactcgatacact

SEQ ID NO: 74485 - DNA, 15 bp, Artificial Sequence
  dgRNA
  Olfr129
agtaaagtaagcgtg

SEQ ID NO: 74486 - DNA, 15 bp, Artificial Sequence
  dgRNA
  Olfr129
agtaagcgtgtggtg

SEQ ID NO: 74487 - DNA, 15 bp, Artificial Sequence
  dgRNA
  Kpna3
cgtcctctcacggcg

SEQ ID NO: 74488 - DNA, 15 bp, Artificial Sequence
  dgRNA
  Kpna3
gctcagacccgcgcc

SEQ ID NO: 74489 - DNA, 15 bp, Artificial Sequence
  dgRNA
  Kpna3
ccgcgcctggcatgc

SEQ ID NO: 74490 - DNA, 15 bp, Artificial Sequence
  dgRNA
  Kpna3
cgcgcctggcatgct

SEQ ID NO: 74491 - DNA, 15 bp, Artificial Sequence
  dgRNA
  Serpinb6d
ggattagctgcctaa

SEQ ID NO: 74492 - DNA, 15 bp, Artificial Sequence
  dgRNA
  Serpinb6d
tagctgcctaatggc

SEQ ID NO: 74493 - DNA, 15 bp, Artificial Sequence
  dgRNA
  Serpinb6d
ctgcctaatggcagg

SEQ ID NO: 74494 - DNA, 15 bp, Artificial Sequence
  dgRNA
  Serpinb6d
atggggtgcattgtt

SEQ ID NO: 74495 - DNA, 15 bp, Artificial Sequence
  dgRNA
  Cyp2c66
acccaatccattata

SEQ ID NO: 74496 - DNA, 15 bp, Artificial Sequence
  dgRNA
  Cyp2c66
acaaagtcccctgcg

SEQ ID NO: 74497 - DNA, 15 bp, Artificial Sequence
  dgRNA
  Cyp2c66
tccttataatggatt

SEQ ID NO: 74498 - DNA, 15 bp, Artificial Sequence
  dgRNA
  Cyp2c66
aatctctcctcgcag

SEQ ID NO: 74499 - DNA, 15 bp, Artificial Sequence
  dgRNA
  Pabpc1
ccacgcccgcagcag

SEQ ID NO: 74500 - DNA, 15 bp, Artificial Sequence
  dgRNA
  Pabpc1
cgccgtcgctcgcgt

SEQ ID NO: 74501 - DNA, 15 bp, Artificial Sequence
  dgRNA
  Pabpc1
gccgtcgctcgcgta

SEQ ID NO: 74502 - DNA, 15 bp, Artificial Sequence
  dgRNA
  Pabpc1
gctcgcgtagggccc

SEQ ID NO: 74503 - DNA, 15 bp, Artificial Sequence
  dgRNA
  Rhox4g
tcactaccgccccca

SEQ ID NO: 74504 - DNA, 15 bp, Artificial Sequence
  dgRNA
  Rhox4g
gaagtgtccaatcat

SEQ ID NO: 74505 - DNA, 15 bp, Artificial Sequence
  dgRNA
  Slirp
caggtccgctgtccc

SEQ ID NO: 74506 - DNA, 15 bp, Artificial Sequence
  dgRNA
  Slirp
tccgctgtccccggc

SEQ ID NO: 74507 - DNA, 15 bp, Artificial Sequence
  dgRNA
  Slirp
cccggccggctctgc

SEQ ID NO: 74508 - DNA, 15 bp, Artificial Sequence
  dgRNA
  Slirp
ctctgccggtagaag

SEQ ID NO: 74509 - DNA, 15 bp, Artificial Sequence
  dgRNA
  Upk1a
cctaccgtgcaccta

SEQ ID NO: 74510 - DNA, 15 bp, Artificial Sequence
  dgRNA
  Upk1a
cgtgcacctaaggaa

SEQ ID NO: 74511 - DNA, 15 bp, Artificial Sequence
  dgRNA
  Upk1a
atcaccttgccccag

SEQ ID NO: 74512 - DNA, 15 bp, Artificial Sequence
  dgRNA
  Upk1a
ggctttcccgagagc

SEQ ID NO: 74513 - DNA, 15 bp, Artificial Sequence
  dgRNA
  Fuk
gtcctttcagtaagg

SEQ ID NO: 74514 - DNA, 15 bp, Artificial Sequence
  dgRNA
  Fuk
cctttcagtaaggcg

SEQ ID NO: 74515 - DNA, 15 bp, Artificial Sequence
  dgRNA
  Fuk
ggcggggctgcgagt

SEQ ID NO: 74516 - DNA, 15 bp, Artificial Sequence
  dgRNA
  Fuk
tgcgagtaggttctg

SEQ ID NO: 74517 - DNA, 15 bp, Artificial Sequence
  dgRNA
  Zbed5
cgccaagcaacttcc

SEQ ID NO: 74518 - DNA, 15 bp, Artificial Sequence
  dgRNA
  Zbed5
agcaacttcccggcg

SEQ ID NO: 74519 - DNA, 15 bp, Artificial Sequence
  dgRNA
  Zbed5
cggcgtggtacgcag

SEQ ID NO: 74520 - DNA, 15 bp, Artificial Sequence
  dgRNA
  Zbed5
cgatcgtgcttctcc

SEQ ID NO: 74521 - DNA, 15 bp, Artificial Sequence
  dgRNA
  Pcid2
ccgcccgtgagcgct

SEQ ID NO: 74522 - DNA, 15 bp, Artificial Sequence
  dgRNA
  Pcid2
ctttctgctcgcggc

SEQ ID NO: 74523 - DNA, 15 bp, Artificial Sequence
  dgRNA
  Pcid2
tttctgctcgcggcc

SEQ ID NO: 74524 - DNA, 15 bp, Artificial Sequence
  dgRNA
  Pcid2
gggtccgcgcgcccg

SEQ ID NO: 74525 - DNA, 15 bp, Artificial Sequence
  dgRNA
  Slc25a18
tgagctattgtatcc

SEQ ID NO: 74526 - DNA, 15 bp, Artificial Sequence
  dgRNA
  Slc25a18
cacgaattttaatgc

SEQ ID NO: 74527 - DNA, 15 bp, Artificial Sequence
  dgRNA
  Slc25a18
aacttgctcatcctg

SEQ ID NO: 74528 - DNA, 15 bp, Artificial Sequence
  dgRNA
  Slc25a18
tgctaaaactgcctc

SEQ ID NO: 74529 - DNA, 15 bp, Artificial Sequence
  dgRNA
  Nol4l
ccgcctctccgtacc

SEQ ID NO: 74530 - DNA, 15 bp, Artificial Sequence
  dgRNA
  Nol4l
cgccgccgctcgcct

SEQ ID NO: 74531 - DNA, 15 bp, Artificial Sequence
  dgRNA
  Nol4l
ggcagtgacgcgccg

SEQ ID NO: 74532 - DNA, 15 bp, Artificial Sequence
  dgRNA
  Nol4l
agtgacgcgccgcgg

SEQ ID NO: 74533 - DNA, 15 bp, Artificial Sequence
  dgRNA
  Elf3
agctcaggttacaac

SEQ ID NO: 74534 - DNA, 15 bp, Artificial Sequence
  dgRNA
  Elf3
gctcaggttacaacc

SEQ ID NO: 74535 - DNA, 15 bp, Artificial Sequence
  dgRNA
  Elf3
ctcaggttacaaccg

SEQ ID NO: 74536 - DNA, 15 bp, Artificial Sequence
  dgRNA
  Elf3
cgtacgccgaagacc

SEQ ID NO: 74537 - DNA, 15 bp, Artificial Sequence
  dgRNA
  Tank
agttatagtcacggg

SEQ ID NO: 74538 - DNA, 15 bp, Artificial Sequence
  dgRNA
  Tank
ccccagttcaacaca

SEQ ID NO: 74539 - DNA, 15 bp, Artificial Sequence
  dgRNA
  Zwilch
agggactctttttcg

SEQ ID NO: 74540 - DNA, 15 bp, Artificial Sequence
  dgRNA
  Pycr2
aattaccagtgtccc

SEQ ID NO: 74541 - DNA, 15 bp, Artificial Sequence
  dgRNA
  Pycr2
gcagacccgcaccag

SEQ ID NO: 74542 - DNA, 15 bp, Artificial Sequence
  dgRNA
  Pycr2
accagcggagctaac

SEQ ID NO: 74543 - DNA, 15 bp, Artificial Sequence
  dgRNA
  Pycr2
acccgctgcgcgatc

SEQ ID NO: 74544 - DNA, 15 bp, Artificial Sequence
  dgRNA
  Psd2
cgccccgcacaaggt

SEQ ID NO: 74545 - DNA, 15 bp, Artificial Sequence
  dgRNA
  Psd2
gccccgcacaaggtc

SEQ ID NO: 74546 - DNA, 15 bp, Artificial Sequence
  dgRNA
  Psd2
cgggcgcttgtgccc

SEQ ID NO: 74547 - DNA, 15 bp, Artificial Sequence
  dgRNA
  Psd2
tgtgcccaggcgccg

SEQ ID NO: 74548 - DNA, 15 bp, Artificial Sequence
  dgRNA
  Abhd13
gctaccgtagcatga

SEQ ID NO: 74549 - DNA, 15 bp, Artificial Sequence
  dgRNA
  Abhd13
accgtagcatgaagg

SEQ ID NO: 74550 - DNA, 15 bp, Artificial Sequence
  dgRNA
  Abhd13
tccgccttcatgcta

SEQ ID NO: 74551 - DNA, 15 bp, Artificial Sequence
  dgRNA
  Pacsin1
tcggcaaacccgtgc

SEQ ID NO: 74552 - DNA, 15 bp, Artificial Sequence
  dgRNA
  Pacsin1
gcgaaaattcacgag

SEQ ID NO: 74553 - DNA, 15 bp, Artificial Sequence
  dgRNA
  Pacsin1
aggcgcgcctgcgcc

SEQ ID NO: 74554 - DNA, 15 bp, Artificial Sequence
  dgRNA
  Pacsin1
gcgcccggatcaccg

SEQ ID NO: 74555 - DNA, 15 bp, Artificial Sequence
  dgRNA
  Olfr508
catcagttaattcat

SEQ ID NO: 74556 - DNA, 15 bp, Artificial Sequence
  dgRNA
  Olfr508
acatcagttaattca

SEQ ID NO: 74557 - DNA, 15 bp, Artificial Sequence
  dgRNA
  Eif3d
cctcaggggcgaacg

SEQ ID NO: 74558 - DNA, 15 bp, Artificial Sequence
  dgRNA
  Eif3d
ttccgctgactaaga

SEQ ID NO: 74559 - DNA, 15 bp, Artificial Sequence
  dgRNA
  Eif3d
tcgtggtcacgctcg

SEQ ID NO: 74560 - DNA, 15 bp, Artificial Sequence
  dgRNA
  Eif3d
atcgtggtcacgctc

SEQ ID NO: 74561 - DNA, 15 bp, Artificial Sequence
  dgRNA
  Olfr94
gcggggtgctcagag

SEQ ID NO: 74562 - DNA, 15 bp, Artificial Sequence
  dgRNA
  Olfr94
tttatagctgccctt

SEQ ID NO: 74563 - DNA, 15 bp, Artificial Sequence
  dgRNA
  Olfr94
atagctgcccttagg

SEQ ID NO: 74564 - DNA, 15 bp, Artificial Sequence
  dgRNA
  Olfr94
tccttaatccctgga

SEQ ID NO: 74565 - DNA, 15 bp, Artificial Sequence
  dgRNA
  Gpx1
atgactagaaacgtg

SEQ ID NO: 74566 - DNA, 15 bp, Artificial Sequence
  dgRNA
  Gpx1
tgactagaaacgtgt

SEQ ID NO: 74567 - DNA, 15 bp, Artificial Sequence
  dgRNA
  Gpx1
cgttgttattgccag

SEQ ID NO: 74568 - DNA, 15 bp, Artificial Sequence
  dgRNA
  Gpx1
ggccatcttcctagg

SEQ ID NO: 74569 - DNA, 15 bp, Artificial Sequence
  dgRNA
  Amer1
gaaacccgccccgcg

SEQ ID NO: 74570 - DNA, 15 bp, Artificial Sequence
  dgRNA
  Amer1
aaacccgccccgcgt

SEQ ID NO: 74571 - DNA, 15 bp, Artificial Sequence
  dgRNA
  Amer1
cgccccgcgtgggag

SEQ ID NO: 74572 - DNA, 15 bp, Artificial Sequence
  dgRNA
  Amer1
cgtgggagcggaagt

SEQ ID NO: 74573 - DNA, 15 bp, Artificial Sequence
  dgRNA
  Fam163a
gagcaatcctccttg

SEQ ID NO: 74574 - DNA, 15 bp, Artificial Sequence
  dgRNA
  Fam163a
agcaatcctccttgc

SEQ ID NO: 74575 - DNA, 15 bp, Artificial Sequence
  dgRNA
  Fam163a
atcctccttgcgggt

SEQ ID NO: 74576 - DNA, 15 bp, Artificial Sequence
  dgRNA
  Fam163a
tcctccttgcgggtt

SEQ ID NO: 74577 - DNA, 15 bp, Artificial Sequence
  dgRNA
  Smg7
caagcgaggaggagt

SEQ ID NO: 74578 - DNA, 15 bp, Artificial Sequence
  dgRNA
  Smg7
gcgaggaggagtcgg

SEQ ID NO: 74579 - DNA, 15 bp, Artificial Sequence
  dgRNA
  Smg7
cgactcctcctcgct

SEQ ID NO: 74580 - DNA, 15 bp, Artificial Sequence
  dgRNA
  Olfr351
ttaaaacccaatggt

SEQ ID NO: 74581 - DNA, 15 bp, Artificial Sequence
  dgRNA
  Olfr351
gatagtcagaatata

SEQ ID NO: 74582 - DNA, 15 bp, Artificial Sequence
  dgRNA
  Olfr351
gtatagagcatctgt

SEQ ID NO: 74583 - DNA, 15 bp, Artificial Sequence
  dgRNA
  Ppp1r3c
ccttccagcacgctc

SEQ ID NO: 74584 - DNA, 15 bp, Artificial Sequence
  dgRNA
  Ppp1r3c
tcacatccagccccg

SEQ ID NO: 74585 - DNA, 15 bp, Artificial Sequence
  dgRNA
  Ppp1r3c
cggtgatcacgttcc

SEQ ID NO: 74586 - DNA, 15 bp, Artificial Sequence
  dgRNA
  Ppp1r3c
ggtgatcacgttcca

SEQ ID NO: 74587 - DNA, 15 bp, Artificial Sequence
  dgRNA
  Gm8994
gatctggaccttggt

SEQ ID NO: 74588 - DNA, 15 bp, Artificial Sequence
  dgRNA
  Pcx
tcttctggggacgcg

SEQ ID NO: 74589 - DNA, 15 bp, Artificial Sequence
  dgRNA
  Pcx
cttctggggacgcga

SEQ ID NO: 74590 - DNA, 15 bp, Artificial Sequence
  dgRNA
  Pcx
ttctggggacgcgag

SEQ ID NO: 74591 - DNA, 15 bp, Artificial Sequence
  dgRNA
  Pcx
ggcggagtcgacgtg

SEQ ID NO: 74592 - DNA, 15 bp, Artificial Sequence
  dgRNA
  Cdk11b
ccagcctcgcgtcgt

SEQ ID NO: 74593 - DNA, 15 bp, Artificial Sequence
  dgRNA
  Cdk11b
cctcgcgtcgttggc

SEQ ID NO: 74594 - DNA, 15 bp, Artificial Sequence
  dgRNA
  Cdk11b
ccaactcacgatgta

SEQ ID NO: 74595 - DNA, 15 bp, Artificial Sequence
  dgRNA
  Cdk11b
atgtaaggacacttc

SEQ ID NO: 74596 - DNA, 15 bp, Artificial Sequence
  dgRNA
  Rad21l
ccttaaatacaacta

SEQ ID NO: 74597 - DNA, 15 bp, Artificial Sequence
  dgRNA
  Rad21l
ccttagttgtattta

SEQ ID NO: 74598 - DNA, 15 bp, Artificial Sequence
  dgRNA
  Cipc
gtctggggaatcgac

SEQ ID NO: 74599 - DNA, 15 bp, Artificial Sequence
  dgRNA
  Cipc
ctgtgagtgagccgc

SEQ ID NO: 74600 - DNA, 15 bp, Artificial Sequence
  dgRNA
  Cipc
tgtgagtgagccgcc

SEQ ID NO: 74601 - DNA, 15 bp, Artificial Sequence
  dgRNA
  Cipc
ccgggacaccgcgcc

SEQ ID NO: 74602 - DNA, 15 bp, Artificial Sequence
  dgRNA
  Preb
ccgctagtgctgacg

SEQ ID NO: 74603 - DNA, 15 bp, Artificial Sequence
  dgRNA
  Preb
agtgctgacgcggat

SEQ ID NO: 74604 - DNA, 15 bp, Artificial Sequence
  dgRNA
  Preb
cgcgtcagcactagc

SEQ ID NO: 74605 - DNA, 15 bp, Artificial Sequence
  dgRNA
  Preb
acgcgccgagctcct

SEQ ID NO: 74606 - DNA, 15 bp, Artificial Sequence
  dgRNA
  Rttn
cccgcgtctgaaagc

SEQ ID NO: 74607 - DNA, 15 bp, Artificial Sequence
  dgRNA
  Rttn
agtaccaaggagcga

SEQ ID NO: 74608 - DNA, 15 bp, Artificial Sequence
  dgRNA
  Rttn
taccaaggagcgaag

SEQ ID NO: 74609 - DNA, 15 bp, Artificial Sequence
  dgRNA
  Rttn
gcgaaggggcgtgta

SEQ ID NO: 74610 - DNA, 15 bp, Artificial Sequence
  dgRNA
  Ndrg1
aaaggcttgcgcaac

SEQ ID NO: 74611 - DNA, 15 bp, Artificial Sequence
  dgRNA
  Ndrg1
ggcttgcgcaacagg

SEQ ID NO: 74612 - DNA, 15 bp, Artificial Sequence
  dgRNA
  Ndrg1
ttgcgcaacaggcgg

SEQ ID NO: 74613 - DNA, 15 bp, Artificial Sequence
  dgRNA
  Ndrg1
gggtgcagcacgagg

SEQ ID NO: 74614 - DNA, 15 bp, Artificial Sequence
  dgRNA
  Gpatch8
accgagcgatgtgag

SEQ ID NO: 74615 - DNA, 15 bp, Artificial Sequence
  dgRNA
  Gpatch8
gaaggttccgcctcc

SEQ ID NO: 74616 - DNA, 15 bp, Artificial Sequence
  dgRNA
  Gpatch8
aggcctgcgcgcctt

SEQ ID NO: 74617 - DNA, 15 bp, Artificial Sequence
  dgRNA
  Gpatch8
ggcctgcgcgccttc

SEQ ID NO: 74618 - DNA, 15 bp, Artificial Sequence
  dgRNA
  Zhx2
ttttgccgaagtctg

SEQ ID NO: 74619 - DNA, 15 bp, Artificial Sequence
  dgRNA
  Zhx2
tttgccgaagtctgc

SEQ ID NO: 74620 - DNA, 15 bp, Artificial Sequence
  dgRNA
  Zhx2
ttgccgaagtctgcg

SEQ ID NO: 74621 - DNA, 15 bp, Artificial Sequence
  dgRNA
  Zhx2
tgccgaagtctgcgg

SEQ ID NO: 74622 - DNA, 15 bp, Artificial Sequence
  dgRNA
  Tmem200a
agcttaaaccctctg

SEQ ID NO: 74623 - DNA, 15 bp, Artificial Sequence
  dgRNA
  Tmem200a
gcttaaaccctctga

SEQ ID NO: 74624 - DNA, 15 bp, Artificial Sequence
  dgRNA
  Tmem200a
gagtgcagtatctct

SEQ ID NO: 74625 - DNA, 15 bp, Artificial Sequence
  dgRNA
  Tmem200a
agtgcagtatctctt

SEQ ID NO: 74626 - DNA, 15 bp, Artificial Sequence
  dgRNA
  Cyp3a44
agatcgttaccttaa

SEQ ID NO: 74627 - DNA, 15 bp, Artificial Sequence
  dgRNA
  Cyp3a44
tcgttaccttaaagg

SEQ ID NO: 74628 - DNA, 15 bp, Artificial Sequence
  dgRNA
  Cyp3a44
atacgaccaaagtac

SEQ ID NO: 74629 - DNA, 15 bp, Artificial Sequence
  dgRNA
  Cyp3a44
tgttgacctccttta

SEQ ID NO: 74630 - DNA, 15 bp, Artificial Sequence
  dgRNA
  Cobl
gccccgcgcagccac

SEQ ID NO: 74631 - DNA, 15 bp, Artificial Sequence
  dgRNA
  Cobl
ccgcgcagccacagg

SEQ ID NO: 74632 - DNA, 15 bp, Artificial Sequence
  dgRNA
  Cobl
gttcctccagccggc

SEQ ID NO: 74633 - DNA, 15 bp, Artificial Sequence
  dgRNA
  Cobl
ttcctccagccggct

SEQ ID NO: 74634 - DNA, 15 bp, Artificial Sequence
  dgRNA
  Kap
gcaatgggggtgatc

SEQ ID NO: 74635 - DNA, 15 bp, Artificial Sequence
  dgRNA
  Kap
ggagtagatgacccc

SEQ ID NO: 74636 - DNA, 15 bp, Artificial Sequence
  dgRNA
  Kap
acccctggccattag

SEQ ID NO: 74637 - DNA, 15 bp, Artificial Sequence
  dgRNA
  Kap
cccctggccattaga

SEQ ID NO: 74638 - DNA, 15 bp, Artificial Sequence
  dgRNA
  Klhl18
gtcaattaacctgga

SEQ ID NO: 74639 - DNA, 15 bp, Artificial Sequence
  dgRNA
  Klhl18
tgagtttgagttacg

SEQ ID NO: 74640 - DNA, 15 bp, Artificial Sequence
  dgRNA
  Klhl18
gagtttgagttacgg

SEQ ID NO: 74641 - DNA, 15 bp, Artificial Sequence
  dgRNA
  Klhl18
agtttgagttacggg

SEQ ID NO: 74642 - DNA, 15 bp, Artificial Sequence
  dgRNA
  Dram1
tcaagcaaaagcgaa

SEQ ID NO: 74643 - DNA, 15 bp, Artificial Sequence
  dgRNA
  Dram1
cgaaaggaagccgag

SEQ ID NO: 74644 - DNA, 15 bp, Artificial Sequence
  dgRNA
  Dram1
ccgagcggtcccgcg

SEQ ID NO: 74645 - DNA, 15 bp, Artificial Sequence
  dgRNA
  Dram1
cggtcccgcgtggcg

SEQ ID NO: 74646 - DNA, 15 bp, Artificial Sequence
  dgRNA
  Olfr1276
gggctttgctaattg

SEQ ID NO: 74647 - DNA, 15 bp, Artificial Sequence
  dgRNA
  Wnt11
ggtcgctacgtcagt

SEQ ID NO: 74648 - DNA, 15 bp, Artificial Sequence
  dgRNA
  Wnt11
ttttcgcgctgctgc

SEQ ID NO: 74649 - DNA, 15 bp, Artificial Sequence
  dgRNA
  Wnt11
tcgcgctgctgctgg

SEQ ID NO: 74650 - DNA, 15 bp, Artificial Sequence
  dgRNA
  Wnt11
tgggcgacacgccct

SEQ ID NO: 74651 - DNA, 15 bp, Artificial Sequence
  dgRNA
  Sp110
cggaattggtgtggc

SEQ ID NO: 74652 - DNA, 15 bp, Artificial Sequence
  dgRNA
  Tead1
cctccggagcgagtt

SEQ ID NO: 74653 - DNA, 15 bp, Artificial Sequence
  dgRNA
  Tead1
gagcgagttcggtcc

SEQ ID NO: 74654 - DNA, 15 bp, Artificial Sequence
  dgRNA
  Tead1
cgctccggaggggtg

SEQ ID NO: 74655 - DNA, 15 bp, Artificial Sequence
  dgRNA
  Tead1
tcgctccggaggggt

SEQ ID NO: 74656 - DNA, 15 bp, Artificial Sequence
  dgRNA
  4930544G11Rik
ccatcacgcctacgt

SEQ ID NO: 74657 - DNA, 15 bp, Artificial Sequence
  dgRNA
  4930544G11Rik
atatgtgtggttggc

SEQ ID NO: 74658 - DNA, 15 bp, Artificial Sequence
  dgRNA
  4930544G11Rik
aggctcgagccaagc

SEQ ID NO: 74659 - DNA, 15 bp, Artificial Sequence
  dgRNA
  4930544G11Rik
ggctcgagccaagct

SEQ ID NO: 74660 - DNA, 15 bp, Artificial Sequence
  dgRNA
  Ccdc190
gtagaagcgaagcag

SEQ ID NO: 74661 - DNA, 15 bp, Artificial Sequence
  dgRNA
  Ccdc190
attgcgctccacgct

SEQ ID NO: 74662 - DNA, 15 bp, Artificial Sequence
  dgRNA
  Ccdc190
tattgcgctccacgc

SEQ ID NO: 74663 - DNA, 15 bp, Artificial Sequence
  dgRNA
  Pde1c
gccaaatcatatgaa

SEQ ID NO: 74664 - DNA, 15 bp, Artificial Sequence
  dgRNA
  Pde1c
ctggtcccgttctgc

SEQ ID NO: 74665 - DNA, 15 bp, Artificial Sequence
  dgRNA
  Pde1c
tggtcccgttctgct

SEQ ID NO: 74666 - DNA, 15 bp, Artificial Sequence
  dgRNA
  Pde1c
aggggaccatctagc

SEQ ID NO: 74667 - DNA, 15 bp, Artificial Sequence
  dgRNA
  Jarid2
tcgtggaggcctttc

SEQ ID NO: 74668 - DNA, 15 bp, Artificial Sequence
  dgRNA
  Jarid2
cgtggaggcctttcc

SEQ ID NO: 74669 - DNA, 15 bp, Artificial Sequence
  dgRNA
  Jarid2
gtggaggcctttccg

SEQ ID NO: 74670 - DNA, 15 bp, Artificial Sequence
  dgRNA
  Jarid2
ccggggtctcgtcga

SEQ ID NO: 74671 - DNA, 15 bp, Artificial Sequence
  dgRNA
  Wdr45
agcattggtaggttg

SEQ ID NO: 74672 - DNA, 15 bp, Artificial Sequence
  dgRNA
  Wdr45
gaggttttcctaggc

SEQ ID NO: 74673 - DNA, 15 bp, Artificial Sequence
  dgRNA
  Wdr45
ttcctaggcaggata

SEQ ID NO: 74674 - DNA, 15 bp, Artificial Sequence
  dgRNA
  Wdr45
gggctagcgtgccct

SEQ ID NO: 74675 - DNA, 15 bp, Artificial Sequence
  dgRNA
  Rbm15
ttgtcccgcccagac

SEQ ID NO: 74676 - DNA, 15 bp, Artificial Sequence
  dgRNA
  Rbm15
aagttccagactcga

SEQ ID NO: 74677 - DNA, 15 bp, Artificial Sequence
  dgRNA
  Rbm15
gaaggaccgaagcac

SEQ ID NO: 74678 - DNA, 15 bp, Artificial Sequence
  dgRNA
  Rbm15
ggcaagtacgccgta

SEQ ID NO: 74679 - DNA, 15 bp, Artificial Sequence
  dgRNA
  Trappc11
gatcgcgtctcctat

SEQ ID NO: 74680 - DNA, 15 bp, Artificial Sequence
  dgRNA
  Trappc11
aacccgttctattcc

SEQ ID NO: 74681 - DNA, 15 bp, Artificial Sequence
  dgRNA
  Trappc11
gttctattccaggac

SEQ ID NO: 74682 - DNA, 15 bp, Artificial Sequence
  dgRNA
  Trappc11
ttcctgtgccagcgg

SEQ ID NO: 74683 - DNA, 15 bp, Artificial Sequence
  dgRNA
  Focad
tgcgaagtctggctg

SEQ ID NO: 74684 - DNA, 15 bp, Artificial Sequence
  dgRNA
  Focad
tgcagtgagccgcca

SEQ ID NO: 74685 - DNA, 15 bp, Artificial Sequence
  dgRNA
  Focad
tcacgcatgcgcgcg

SEQ ID NO: 74686 - DNA, 15 bp, Artificial Sequence
  dgRNA
  Focad
acgcatgcgcgcgag

SEQ ID NO: 74687 - DNA, 15 bp, Artificial Sequence
  dgRNA
  Pabpc5
caatctcttgatccc

SEQ ID NO: 74688 - DNA, 15 bp, Artificial Sequence
  dgRNA
  Pabpc5
gcaatctctgtccgt

SEQ ID NO: 74689 - DNA, 15 bp, Artificial Sequence
  dgRNA
  Pabpc5
tccgttggtccccac

SEQ ID NO: 74690 - DNA, 15 bp, Artificial Sequence
  dgRNA
  Pabpc5
ccgttggtccccact

SEQ ID NO: 74691 - DNA, 15 bp, Artificial Sequence
  dgRNA
  Olfr641
atgaaactattggtt

SEQ ID NO: 74692 - DNA, 15 bp, Artificial Sequence
  dgRNA
  1700129C05Rik
tgtgcacttcacaat

SEQ ID NO: 74693 - DNA, 15 bp, Artificial Sequence
  dgRNA
  1700129C05Rik
tggcactgaacatcg

SEQ ID NO: 74694 - DNA, 15 bp, Artificial Sequence
  dgRNA
  Nckap5l
ccactcgggcggaag

SEQ ID NO: 74695 - DNA, 15 bp, Artificial Sequence
  dgRNA
  Nckap5l
cggcgcgcgccggcc

SEQ ID NO: 74696 - DNA, 15 bp, Artificial Sequence
  dgRNA
  Nckap5l
acttagctctcgtcc

SEQ ID NO: 74697 - DNA, 15 bp, Artificial Sequence
  dgRNA
  Nckap5l
cttagctctcgtcct

SEQ ID NO: 74698 - DNA, 15 bp, Artificial Sequence
  dgRNA
  Lrfn4
gagcgcccggcaggg

SEQ ID NO: 74699 - DNA, 15 bp, Artificial Sequence
  dgRNA
  Lrfn4
agcgcccggcagggc

SEQ ID NO: 74700 - DNA, 15 bp, Artificial Sequence
  dgRNA
  Lrfn4
cccggcagggcggga

SEQ ID NO: 74701 - DNA, 15 bp, Artificial Sequence
  dgRNA
  Lrfn4
acgacgccagtcccc

SEQ ID NO: 74702 - DNA, 15 bp, Artificial Sequence
  dgRNA
  Klrg2
tgtgactcgctcaac

SEQ ID NO: 74703 - DNA, 15 bp, Artificial Sequence
  dgRNA
  Klrg2
gtgactcgctcaacc

SEQ ID NO: 74704 - DNA, 15 bp, Artificial Sequence
  dgRNA
  Klrg2
cagcaaccggtgcca

SEQ ID NO: 74705 - DNA, 15 bp, Artificial Sequence
  dgRNA
  Klrg2
accggtgccacggaa

SEQ ID NO: 74706 - DNA, 15 bp, Artificial Sequence
  dgRNA
  Ms4a8a
ttccataactaaaac

SEQ ID NO: 74707 - DNA, 15 bp, Artificial Sequence
  dgRNA
  Ms4a8a
tgacctggacattca

SEQ ID NO: 74708 - DNA, 15 bp, Artificial Sequence
  dgRNA
  Ms4a8a
atgacctggacattc

SEQ ID NO: 74709 - DNA, 15 bp, Artificial Sequence
  dgRNA
  Ms4a8a
ttcaaggtgcctgaa

SEQ ID NO: 74710 - DNA, 15 bp, Artificial Sequence
  dgRNA
  Magi3
taccgatacgagcct

SEQ ID NO: 74711 - DNA, 15 bp, Artificial Sequence
  dgRNA
  Magi3
gcctttcccgccgcg

SEQ ID NO: 74712 - DNA, 15 bp, Artificial Sequence
  dgRNA
  Magi3
cctttcccgccgcgc

SEQ ID NO: 74713 - DNA, 15 bp, Artificial Sequence
  dgRNA
  Magi3
ccgagtcccggccgt

SEQ ID NO: 74714 - DNA, 15 bp, Artificial Sequence
  dgRNA
  Fgf11
gctagtcagggccca

SEQ ID NO: 74715 - DNA, 15 bp, Artificial Sequence
  dgRNA
  Fgf11
gagccggtggtgttg

SEQ ID NO: 74716 - DNA, 15 bp, Artificial Sequence
  dgRNA
  Fgf11
tgttggggaacgtac

SEQ ID NO: 74717 - DNA, 15 bp, Artificial Sequence
  dgRNA
  Fgf11
gttggggaacgtact

SEQ ID NO: 74718 - DNA, 15 bp, Artificial Sequence
  dgRNA
  Dclk1
aggcgacctcaatac

SEQ ID NO: 74719 - DNA, 15 bp, Artificial Sequence
  dgRNA
  Dclk1
ggtcgccttcatcaa

SEQ ID NO: 74720 - DNA, 15 bp, Artificial Sequence
  dgRNA
  Dclk1
agtggtccagtattg

SEQ ID NO: 74721 - DNA, 15 bp, Artificial Sequence
  dgRNA
  Dclk1
aagcaggtcatgtgc

SEQ ID NO: 74722 - DNA, 15 bp, Artificial Sequence
  dgRNA
  Rbm47
tccatttaactagat

SEQ ID NO: 74723 - DNA, 15 bp, Artificial Sequence
  dgRNA
  Rbm47
ccatttaactagatg

SEQ ID NO: 74724 - DNA, 15 bp, Artificial Sequence
  dgRNA
  Rbm47
catttaactagatgg

SEQ ID NO: 74725 - DNA, 15 bp, Artificial Sequence
  dgRNA
  Rbm47
atttaactagatggg

SEQ ID NO: 74726 - DNA, 15 bp, Artificial Sequence
  dgRNA
  Mthfr
gtggctgcagacggg

SEQ ID NO: 74727 - DNA, 15 bp, Artificial Sequence
  dgRNA
  Mthfr
tggctgcagacgggt

SEQ ID NO: 74728 - DNA, 15 bp, Artificial Sequence
  dgRNA
  Mthfr
ggctgcagacgggtg

SEQ ID NO: 74729 - DNA, 15 bp, Artificial Sequence
  dgRNA
  Mthfr
agacgggtggggcga

SEQ ID NO: 74730 - DNA, 15 bp, Artificial Sequence
  dgRNA
  Iqcj
aattcattcctgagt

SEQ ID NO: 74731 - DNA, 15 bp, Artificial Sequence
  dgRNA
  Iqcj
tcgtctccctgtctg

SEQ ID NO: 74732 - DNA, 15 bp, Artificial Sequence
  dgRNA
  Iqcj
cgtctccctgtctgt

SEQ ID NO: 74733 - DNA, 15 bp, Artificial Sequence
  dgRNA
  Iqcj
gcgagctcaactcaa

SEQ ID NO: 74734 - DNA, 15 bp, Artificial Sequence
  dgRNA
  Abcd3
caagcagagatcgca

SEQ ID NO: 74735 - DNA, 15 bp, Artificial Sequence
  dgRNA
  Abcd3
cgcaaggccgaagcg

SEQ ID NO: 74736 - DNA, 15 bp, Artificial Sequence
  dgRNA
  Abcd3
gcaaggccgaagcgt

SEQ ID NO: 74737 - DNA, 15 bp, Artificial Sequence
  dgRNA
  Abcd3
cgaagcgtgggctgc

SEQ ID NO: 74738 - DNA, 15 bp, Artificial Sequence
  dgRNA
  Sgk1
gtttgtctacatagc

SEQ ID NO: 74739 - DNA, 15 bp, Artificial Sequence
  dgRNA
  Sgk1
tgaaagtcatttcgt

SEQ ID NO: 74740 - DNA, 15 bp, Artificial Sequence
  dgRNA
  Sgk1
gtcatttcgtaggac

SEQ ID NO: 74741 - DNA, 15 bp, Artificial Sequence
  dgRNA
  Sgk1
tcatttcgtaggacc

SEQ ID NO: 74742 - DNA, 15 bp, Artificial Sequence
  dgRNA
  Adck5
atgaggctatgcccc

SEQ ID NO: 74743 - DNA, 15 bp, Artificial Sequence
  dgRNA
  Adck5
ccccgggcgacctca

SEQ ID NO: 74744 - DNA, 15 bp, Artificial Sequence
  dgRNA
  Adck5
cccgggcgacctcaa

SEQ ID NO: 74745 - DNA, 15 bp, Artificial Sequence
  dgRNA
  Adck5
ccgggcgacctcaag

SEQ ID NO: 74746 - DNA, 15 bp, Artificial Sequence
  dgRNA
  Hnrnpll
tttcgctcttccaat

SEQ ID NO: 74747 - DNA, 15 bp, Artificial Sequence
  dgRNA
  Hnrnpll
cgctcttccaatagg

SEQ ID NO: 74748 - DNA, 15 bp, Artificial Sequence
  dgRNA
  Hnrnpll
tcttccaataggagg

SEQ ID NO: 74749 - DNA, 15 bp, Artificial Sequence
  dgRNA
  Hnrnpll
taggaggcggaagtt

SEQ ID NO: 74750 - DNA, 15 bp, Artificial Sequence
  dgRNA
  Il20ra
acagccaccctcgcg

SEQ ID NO: 74751 - DNA, 15 bp, Artificial Sequence
  dgRNA
  Il20ra
gcgtggactccctgc

SEQ ID NO: 74752 - DNA, 15 bp, Artificial Sequence
  dgRNA
  Il20ra
gtggactccctgcag

SEQ ID NO: 74753 - DNA, 15 bp, Artificial Sequence
  dgRNA
  Il20ra
tgggctccatcgccc

SEQ ID NO: 74754 - DNA, 15 bp, Artificial Sequence
  dgRNA
  R3hdm2
aagtggattagagcc

SEQ ID NO: 74755 - DNA, 15 bp, Artificial Sequence
  dgRNA
  Ms4a3
tcttaatggtatact

SEQ ID NO: 74756 - DNA, 15 bp, Artificial Sequence
  dgRNA
  Ms4a3
cttaatggtatactt

SEQ ID NO: 74757 - DNA, 15 bp, Artificial Sequence
  dgRNA
  Ms4a3
ttaatggtatacttg

SEQ ID NO: 74758 - DNA, 15 bp, Artificial Sequence
  dgRNA
  Ms4a3
ttagtgccctcaaat

SEQ ID NO: 74759 - DNA, 15 bp, Artificial Sequence
  dgRNA
  Grm3
gcgcgcagccgggcg

SEQ ID NO: 74760 - DNA, 15 bp, Artificial Sequence
  dgRNA
  Grm3
gcttcgcgcacaagt

SEQ ID NO: 74761 - DNA, 15 bp, Artificial Sequence
  dgRNA
  Grm3
cccttggatttagaa

SEQ ID NO: 74762 - DNA, 15 bp, Artificial Sequence
  dgRNA
  Grm3
ttgtgtcggatgaag

SEQ ID NO: 74763 - DNA, 15 bp, Artificial Sequence
  dgRNA
  Bcl10
gggggcgtggttaga

SEQ ID NO: 74764 - DNA, 15 bp, Artificial Sequence
  dgRNA
  Bcl10
gagggacgcccgctg

SEQ ID NO: 74765 - DNA, 15 bp, Artificial Sequence
  dgRNA
  Bcl10
agggacgcccgctgt

SEQ ID NO: 74766 - DNA, 15 bp, Artificial Sequence
  dgRNA
  Bcl10
gacgcccgctgtggg

SEQ ID NO: 74767 - DNA, 15 bp, Artificial Sequence
  dgRNA
  Nadk
ccgcccacttcctct

SEQ ID NO: 74768 - DNA, 15 bp, Artificial Sequence
  dgRNA
  Nadk
gcggaagacagcacg

SEQ ID NO: 74769 - DNA, 15 bp, Artificial Sequence
  dgRNA
  Nadk
agcggaagacagcac

SEQ ID NO: 74770 - DNA, 15 bp, Artificial Sequence
  dgRNA
  Nadk
atagcggaatgggat

SEQ ID NO: 74771 - DNA, 15 bp, Artificial Sequence
  dgRNA
  Mob3a
cgtcctggtctccag

SEQ ID NO: 74772 - DNA, 15 bp, Artificial Sequence
  dgRNA
  Mob3a
tggtctccaggggcg

SEQ ID NO: 74773 - DNA, 15 bp, Artificial Sequence
  dgRNA
  Mob3a
gtgatcctccgaact

SEQ ID NO: 74774 - DNA, 15 bp, Artificial Sequence
  dgRNA
  Mob3a
tgatcctccgaactc

SEQ ID NO: 74775 - DNA, 15 bp, Artificial Sequence
  dgRNA
  Rbbp7
gccgacttcctgccg

SEQ ID NO: 74776 - DNA, 15 bp, Artificial Sequence
  dgRNA
  Rbbp7
cgagaagcccacccc

SEQ ID NO: 74777 - DNA, 15 bp, Artificial Sequence
  dgRNA
  Rbbp7
cccgtcgcacgctat

SEQ ID NO: 74778 - DNA, 15 bp, Artificial Sequence
  dgRNA
  Rbbp7
aagccgccgagccgt

SEQ ID NO: 74779 - DNA, 15 bp, Artificial Sequence
  dgRNA
  Asb3
aagcgtccttagtgc

SEQ ID NO: 74780 - DNA, 15 bp, Artificial Sequence
  dgRNA
  Asb3
agcgtccttagtgca

SEQ ID NO: 74781 - DNA, 15 bp, Artificial Sequence
  dgRNA
  Asb3
gcgtccttagtgcag

SEQ ID NO: 74782 - DNA, 15 bp, Artificial Sequence
  dgRNA
  Asb3
acgtctccttgcaga

SEQ ID NO: 74783 - DNA, 15 bp, Artificial Sequence
  dgRNA
  Ube2i
tgatgtgtcctcgag

SEQ ID NO: 74784 - DNA, 15 bp, Artificial Sequence
  dgRNA
  Ube2i
gcgctcatcccgaag

SEQ ID NO: 74785 - DNA, 15 bp, Artificial Sequence
  dgRNA
  Ube2i
cgctccctcgagcct

SEQ ID NO: 74786 - DNA, 15 bp, Artificial Sequence
  dgRNA
  Ube2i
ctcgagcctaggacg

SEQ ID NO: 74787 - DNA, 15 bp, Artificial Sequence
  dgRNA
  Slc12a6
cacggattcttaatt

SEQ ID NO: 74788 - DNA, 15 bp, Artificial Sequence
  dgRNA
  Slc12a6
ttaattgggcctttg

SEQ ID NO: 74789 - DNA, 15 bp, Artificial Sequence
  dgRNA
  Slc12a6
taattgggcctttgt

SEQ ID NO: 74790 - DNA, 15 bp, Artificial Sequence
  dgRNA
  Slc12a6
tgtgggctgtaaatc

SEQ ID NO: 74791 - DNA, 15 bp, Artificial Sequence
  dgRNA
  Sirt6
gtgctataagcactc

SEQ ID NO: 74792 - DNA, 15 bp, Artificial Sequence
  dgRNA
  Sirt6
ataagcactccgggc

SEQ ID NO: 74793 - DNA, 15 bp, Artificial Sequence
  dgRNA
  Sirt6
aacagggagttggtc

SEQ ID NO: 74794 - DNA, 15 bp, Artificial Sequence
  dgRNA
  Sirt6
ctcgactcctgtgag

SEQ ID NO: 74795 - DNA, 15 bp, Artificial Sequence
  dgRNA
  Fmr1nb
ccgattttaaccctt

SEQ ID NO: 74796 - DNA, 15 bp, Artificial Sequence
  dgRNA
  Dpysl5
aaggcggcggcaacg

SEQ ID NO: 74797 - DNA, 15 bp, Artificial Sequence
  dgRNA
  Dpysl5
gcggcggcaacgcgg

SEQ ID NO: 74798 - DNA, 15 bp, Artificial Sequence
  dgRNA
  Dpysl5
gcaacgcggaggacg

SEQ ID NO: 74799 - DNA, 15 bp, Artificial Sequence
  dgRNA
  Dpysl5
caacgcggaggacgc

SEQ ID NO: 74800 - DNA, 15 bp, Artificial Sequence
  dgRNA
  Slc15a4
ggaacctcggagtct

SEQ ID NO: 74801 - DNA, 15 bp, Artificial Sequence
  dgRNA
  Slc15a4
gaacctcggagtcta

SEQ ID NO: 74802 - DNA, 15 bp, Artificial Sequence
  dgRNA
  Slc15a4
gttccagtttcccgg

SEQ ID NO: 74803 - DNA, 15 bp, Artificial Sequence
  dgRNA
  Slc15a4
aacccctccagccat

SEQ ID NO: 74804 - DNA, 15 bp, Artificial Sequence
  dgRNA
  Ankrd29
aatggaaaccgtctg

SEQ ID NO: 74805 - DNA, 15 bp, Artificial Sequence
  dgRNA
  Ankrd29
agcgagacctgagtg

SEQ ID NO: 74806 - DNA, 15 bp, Artificial Sequence
  dgRNA
  Ankrd29
ctctgggagtgcacg

SEQ ID NO: 74807 - DNA, 15 bp, Artificial Sequence
  dgRNA
  Ankrd29
gtgcacgcggagctc

SEQ ID NO: 74808 - DNA, 15 bp, Artificial Sequence
  dgRNA
  Ms4a4a
tcagcagtaaccttt

SEQ ID NO: 74809 - DNA, 15 bp, Artificial Sequence
  dgRNA
  Ms4a4a
ctagttgtgtacatg

SEQ ID NO: 74810 - DNA, 15 bp, Artificial Sequence
  dgRNA
  Ms4a4a
taaaggttactgctg

SEQ ID NO: 74811 - DNA, 15 bp, Artificial Sequence
  dgRNA
  Bysl
tcactcccatagcga

SEQ ID NO: 74812 - DNA, 15 bp, Artificial Sequence
  dgRNA
  Bysl
tagcgaaggatcaaa

SEQ ID NO: 74813 - DNA, 15 bp, Artificial Sequence
  dgRNA
  Bysl
cgaaggatcaaaagg

SEQ ID NO: 74814 - DNA, 15 bp, Artificial Sequence
  dgRNA
  Bysl
agaccttcacgcgaa

SEQ ID NO: 74815 - DNA, 15 bp, Artificial Sequence
  dgRNA
  Mrps23
tgccgcttccgcttc

SEQ ID NO: 74816 - DNA, 15 bp, Artificial Sequence
  dgRNA
  Mrps23
tccggtaacagcccg

SEQ ID NO: 74817 - DNA, 15 bp, Artificial Sequence
  dgRNA
  Mrps23
gctttctagcccaag

SEQ ID NO: 74818 - DNA, 15 bp, Artificial Sequence
  dgRNA
  Mrps23
taccggaagcggaag

SEQ ID NO: 74819 - DNA, 15 bp, Artificial Sequence
  dgRNA
  Ablim1
taggggaactgctac

SEQ ID NO: 74820 - DNA, 15 bp, Artificial Sequence
  dgRNA
  Ablim1
aggggaactgctact

SEQ ID NO: 74821 - DNA, 15 bp, Artificial Sequence
  dgRNA
  Ablim1
ggggaactgctactg

SEQ ID NO: 74822 - DNA, 15 bp, Artificial Sequence
  dgRNA
  Zfpl1
cgcggtcgcctactc

SEQ ID NO: 74823 - DNA, 15 bp, Artificial Sequence
  dgRNA
  Zfpl1
caggctcgcgccaac

SEQ ID NO: 74824 - DNA, 15 bp, Artificial Sequence
  dgRNA
  Zfpl1
aggctcgcgccaacc

SEQ ID NO: 74825 - DNA, 15 bp, Artificial Sequence
  dgRNA
  Zfpl1
ttgctagcgagaaag

SEQ ID NO: 74826 - DNA, 15 bp, Artificial Sequence
  dgRNA
  Fam212a
ccgtgctactacagc

SEQ ID NO: 74827 - DNA, 15 bp, Artificial Sequence
  dgRNA
  Fam212a
agggcggggctgaaa

SEQ ID NO: 74828 - DNA, 15 bp, Artificial Sequence
  dgRNA
  Fam212a
ccgcctccattggct

SEQ ID NO: 74829 - DNA, 15 bp, Artificial Sequence
  dgRNA
  Fam212a
cgcctccattggcta

SEQ ID NO: 74830 - DNA, 15 bp, Artificial Sequence
  dgRNA
  Col9a3
tgtaacgcgcggtcc

SEQ ID NO: 74831 - DNA, 15 bp, Artificial Sequence
  dgRNA
  Col9a3
gtaacgcgcggtcct

SEQ ID NO: 74832 - DNA, 15 bp, Artificial Sequence
  dgRNA
  Col9a3
cacgcggcgccccgc

SEQ ID NO: 74833 - DNA, 15 bp, Artificial Sequence
  dgRNA
  Col9a3
gcgccccgccggctc

SEQ ID NO: 74834 - DNA, 15 bp, Artificial Sequence
  dgRNA
  Svs4
cactttgtaccatga

SEQ ID NO: 74835 - DNA, 15 bp, Artificial Sequence
  dgRNA
  Svs4
agtgttgataaagat

SEQ ID NO: 74836 - DNA, 15 bp, Artificial Sequence
  dgRNA
  Cyyr1
tagacctgtggaacc

SEQ ID NO: 74837 - DNA, 15 bp, Artificial Sequence
  dgRNA
  Cyyr1
cctgccattctatag

SEQ ID NO: 74838 - DNA, 15 bp, Artificial Sequence
  dgRNA
  Cyyr1
gaaaactcagcgaag

SEQ ID NO: 74839 - DNA, 15 bp, Artificial Sequence
  dgRNA
  Cyyr1
aaaactcagcgaagt

SEQ ID NO: 74840 - DNA, 15 bp, Artificial Sequence
  dgRNA
  Tmem231
cttgaagagacgcgc

SEQ ID NO: 74841 - DNA, 15 bp, Artificial Sequence
  dgRNA
  Tmem231
ctgcatgcctgctat

SEQ ID NO: 74842 - DNA, 15 bp, Artificial Sequence
  dgRNA
  Tmem231
tcctctgcccgccgt

SEQ ID NO: 74843 - DNA, 15 bp, Artificial Sequence
  dgRNA
  Tmem231
ggcaactgtatgggc

SEQ ID NO: 74844 - DNA, 15 bp, Artificial Sequence
  dgRNA
  Kank1
tgtccctgcactcgg

SEQ ID NO: 74845 - DNA, 15 bp, Artificial Sequence
  dgRNA
  Kank1
caagttactcttgca

SEQ ID NO: 74846 - DNA, 15 bp, Artificial Sequence
  dgRNA
  Kank1
ttgcacggccactgc

SEQ ID NO: 74847 - DNA, 15 bp, Artificial Sequence
  dgRNA
  Kank1
gcgatctagtgtaac

SEQ ID NO: 74848 - DNA, 15 bp, Artificial Sequence
  dgRNA
  Mboat1
agggtgagacggctt

SEQ ID NO: 74849 - DNA, 15 bp, Artificial Sequence
  dgRNA
  Mboat1
gtgagacggcttcgg

SEQ ID NO: 74850 - DNA, 15 bp, Artificial Sequence
  dgRNA
  Mboat1
ggcttcggaggaacc

SEQ ID NO: 74851 - DNA, 15 bp, Artificial Sequence
  dgRNA
  Mboat1
cggaggaacccggat

SEQ ID NO: 74852 - DNA, 15 bp, Artificial Sequence
  dgRNA
  Reg3a
aactaacacacattg

SEQ ID NO: 74853 - DNA, 15 bp, Artificial Sequence
  dgRNA
  Reg3a
gtgatagctagtgct

SEQ ID NO: 74854 - DNA, 15 bp, Artificial Sequence
  dgRNA
  Reg3a
atgcttatttaagtc

SEQ ID NO: 74855 - DNA, 15 bp, Artificial Sequence
  dgRNA
  A430033K04Rik
acacaaacggagggt

SEQ ID NO: 74856 - DNA, 15 bp, Artificial Sequence
  dgRNA
  A430033K04Rik
cacaaacggagggta

SEQ ID NO: 74857 - DNA, 15 bp, Artificial Sequence
  dgRNA
  A430033K04Rik
acaaacggagggtag

SEQ ID NO: 74858 - DNA, 15 bp, Artificial Sequence
  dgRNA
  A430033K04Rik
ggtaggggcgggctt

SEQ ID NO: 74859 - DNA, 15 bp, Artificial Sequence
  dgRNA
  Wfdc2
gtgtccggctgcagc

SEQ ID NO: 74860 - DNA, 15 bp, Artificial Sequence
  dgRNA
  Wfdc2
cggctgcagccggct

SEQ ID NO: 74861 - DNA, 15 bp, Artificial Sequence
  dgRNA
  Wfdc2
caagccggctgcagc

SEQ ID NO: 74862 - DNA, 15 bp, Artificial Sequence
  dgRNA
  Pyroxd2
gaggatcccgcaaca

SEQ ID NO: 74863 - DNA, 15 bp, Artificial Sequence
  dgRNA
  Pyroxd2
cgcaacaaggagcag

SEQ ID NO: 74864 - DNA, 15 bp, Artificial Sequence
  dgRNA
  Pyroxd2
gactaccagacaagc

SEQ ID NO: 74865 - DNA, 15 bp, Artificial Sequence
  dgRNA
  Pyroxd2
cacagcttaggatct

SEQ ID NO: 74866 - DNA, 15 bp, Artificial Sequence
  dgRNA
  Ralb
tcacgtgcgcgagtc

SEQ ID NO: 74867 - DNA, 15 bp, Artificial Sequence
  dgRNA
  Ralb
gtgcgcgagtccggc

SEQ ID NO: 74868 - DNA, 15 bp, Artificial Sequence
  dgRNA
  Ralb
tgcgcgagtccggct

SEQ ID NO: 74869 - DNA, 15 bp, Artificial Sequence
  dgRNA
  Ralb
gcgcgagtccggctg

SEQ ID NO: 74870 - DNA, 15 bp, Artificial Sequence
  dgRNA
  Patl2
caaccacgctgcccc

SEQ ID NO: 74871 - DNA, 15 bp, Artificial Sequence
  dgRNA
  Patl2
gcgccacctgactcc

SEQ ID NO: 74872 - DNA, 15 bp, Artificial Sequence
  dgRNA
  Patl2
cgccacctgactcct

SEQ ID NO: 74873 - DNA, 15 bp, Artificial Sequence
  dgRNA
  Patl2
gcggggcttaagatg

SEQ ID NO: 74874 - DNA, 15 bp, Artificial Sequence
  dgRNA
  Sgta
tctgttttagagcga

SEQ ID NO: 74875 - DNA, 15 bp, Artificial Sequence
  dgRNA
  Sgta
ctgttttagagcgaa

SEQ ID NO: 74876 - DNA, 15 bp, Artificial Sequence
  dgRNA
  Sgta
gagcgcatgcgcaaa

SEQ ID NO: 74877 - DNA, 15 bp, Artificial Sequence
  dgRNA
  Sgta
ggtttttttctgcgc

SEQ ID NO: 74878 - DNA, 15 bp, Artificial Sequence
  dgRNA
  Zbtb41
cgcgcgcatgcgctc

SEQ ID NO: 74879 - DNA, 15 bp, Artificial Sequence
  dgRNA
  Zbtb41
cgctcgggcggatgc

SEQ ID NO: 74880 - DNA, 15 bp, Artificial Sequence
  dgRNA
  Zbtb41
gctcgggcggatgcc

SEQ ID NO: 74881 - DNA, 15 bp, Artificial Sequence
  dgRNA
  Zbtb41
ctcgggcggatgccg

SEQ ID NO: 74882 - DNA, 15 bp, Artificial Sequence
  dgRNA
  Ankrd40
gtctgtcctcctcgc

SEQ ID NO: 74883 - DNA, 15 bp, Artificial Sequence
  dgRNA
  Ankrd40
ctcgctggaagctgc

SEQ ID NO: 74884 - DNA, 15 bp, Artificial Sequence
  dgRNA
  Ankrd40
gataatccagtgcgg

SEQ ID NO: 74885 - DNA, 15 bp, Artificial Sequence
  dgRNA
  Ankrd40
ggttacataaacagc

SEQ ID NO: 74886 - DNA, 15 bp, Artificial Sequence
  dgRNA
  Sar1a
cctccacagagcggg

SEQ ID NO: 74887 - DNA, 15 bp, Artificial Sequence
  dgRNA
  Sar1a
cgtacgtcactcctt

SEQ ID NO: 74888 - DNA, 15 bp, Artificial Sequence
  dgRNA
  Sar1a
aggcccgcctctccg

SEQ ID NO: 74889 - DNA, 15 bp, Artificial Sequence
  dgRNA
  Sar1a
tctccgcggccagag

SEQ ID NO: 74890 - DNA, 15 bp, Artificial Sequence
  dgRNA
  Dkc1
tatagcgcgctaaga

SEQ ID NO: 74891 - DNA, 15 bp, Artificial Sequence
  dgRNA
  Dkc1
cgctctgccaagggt

SEQ ID NO: 74892 - DNA, 15 bp, Artificial Sequence
  dgRNA
  Dkc1
cgcgctataaatagc

SEQ ID NO: 74893 - DNA, 15 bp, Artificial Sequence
  dgRNA
  Dkc1
cagactacagcgggt

SEQ ID NO: 74894 - DNA, 15 bp, Artificial Sequence
  dgRNA
  Bend4
accgggacgccctcc

SEQ ID NO: 74895 - DNA, 15 bp, Artificial Sequence
  dgRNA
  Bend4
gttccgttcccccac

SEQ ID NO: 74896 - DNA, 15 bp, Artificial Sequence
  dgRNA
  Bend4
ttccgttcccccacc

SEQ ID NO: 74897 - DNA, 15 bp, Artificial Sequence
  dgRNA
  Bend4
cccaccgggtcccct

SEQ ID NO: 74898 - DNA, 15 bp, Artificial Sequence
  dgRNA
  Grhpr
tctatccgggacact

SEQ ID NO: 74899 - DNA, 15 bp, Artificial Sequence
  dgRNA
  Grhpr
tataccagaccatag

SEQ ID NO: 74900 - DNA, 15 bp, Artificial Sequence
  dgRNA
  Grhpr
agaccatagaggtcc

SEQ ID NO: 74901 - DNA, 15 bp, Artificial Sequence
  dgRNA
  Grhpr
gaccatagaggtccc

SEQ ID NO: 74902 - DNA, 15 bp, Artificial Sequence
  dgRNA
  Spsb2
cgatgacgtcatcaa

SEQ ID NO: 74903 - DNA, 15 bp, Artificial Sequence
  dgRNA
  Spsb2
gatgacgtcatcaaa

SEQ ID NO: 74904 - DNA, 15 bp, Artificial Sequence
  dgRNA
  Spsb2
gggttaattctagtc

SEQ ID NO: 74905 - DNA, 15 bp, Artificial Sequence
  dgRNA
  Spsb2
ggttaattctagtct

SEQ ID NO: 74906 - DNA, 15 bp, Artificial Sequence
  dgRNA
  1700011H14Rik
tgtcttgtaatggcc

SEQ ID NO: 74907 - DNA, 15 bp, Artificial Sequence
  dgRNA
  1700011H14Rik
gtcttgtaatggcct

SEQ ID NO: 74908 - DNA, 15 bp, Artificial Sequence
  dgRNA
  1700011H14Rik
tcttgtaatggcctg

SEQ ID NO: 74909 - DNA, 15 bp, Artificial Sequence
  dgRNA
  1700011H14Rik
caattatccaacccc

SEQ ID NO: 74910 - DNA, 15 bp, Artificial Sequence
  dgRNA
  Rnf186
agacagcgtccctgt

SEQ ID NO: 74911 - DNA, 15 bp, Artificial Sequence
  dgRNA
  Rnf186
atgtagacactcacc

SEQ ID NO: 74912 - DNA, 15 bp, Artificial Sequence
  dgRNA
  Rnf186
tttggcccttctatc

SEQ ID NO: 74913 - DNA, 15 bp, Artificial Sequence
  dgRNA
  Rnf186
gttactgattaaccc

SEQ ID NO: 74914 - DNA, 15 bp, Artificial Sequence
  dgRNA
  Med22
tggaggcggatagcg

SEQ ID NO: 74915 - DNA, 15 bp, Artificial Sequence
  dgRNA
  Med22
ggaggcggatagcgc

SEQ ID NO: 74916 - DNA, 15 bp, Artificial Sequence
  dgRNA
  Med22
gaggcggatagcgcg

SEQ ID NO: 74917 - DNA, 15 bp, Artificial Sequence
  dgRNA
  Med22
aggcggatagcgcgg

SEQ ID NO: 74918 - DNA, 15 bp, Artificial Sequence
  dgRNA
  Prdx6
gatctaggtctccgc

SEQ ID NO: 74919 - DNA, 15 bp, Artificial Sequence
  dgRNA
  Prdx6
gacctagatcagtgc

SEQ ID NO: 74920 - DNA, 15 bp, Artificial Sequence
  dgRNA
  Prdx6
gcgggcgggctcctg

SEQ ID NO: 74921 - DNA, 15 bp, Artificial Sequence
  dgRNA
  Amot
gttcttcccccttag

SEQ ID NO: 74922 - DNA, 15 bp, Artificial Sequence
  dgRNA
  Amot
gatttatccatcctc

SEQ ID NO: 74923 - DNA, 15 bp, Artificial Sequence
  dgRNA
  Amot
acacgtgttctttga

SEQ ID NO: 74924 - DNA, 15 bp, Artificial Sequence
  dgRNA
  Amot
aatcagtcctctaag

SEQ ID NO: 74925 - DNA, 15 bp, Artificial Sequence
  dgRNA
  Yod1
ttcccgacgatgagt

SEQ ID NO: 74926 - DNA, 15 bp, Artificial Sequence
  dgRNA
  Yod1
tgagtcggctctgcc

SEQ ID NO: 74927 - DNA, 15 bp, Artificial Sequence
  dgRNA
  Yod1
ggcgacctccctgca

SEQ ID NO: 74928 - DNA, 15 bp, Artificial Sequence
  dgRNA
  Yod1
gtcacgccgctggcg

SEQ ID NO: 74929 - DNA, 15 bp, Artificial Sequence
  dgRNA
  Wdr35
ttggtcggggtcggg

SEQ ID NO: 74930 - DNA, 15 bp, Artificial Sequence
  dgRNA
  Wdr35
gagaccttttttgga

SEQ ID NO: 74931 - DNA, 15 bp, Artificial Sequence
  dgRNA
  Wdr35
tccaaaaaaggtctc

SEQ ID NO: 74932 - DNA, 15 bp, Artificial Sequence
  dgRNA
  Wdr35
tcagtataagctaaa

SEQ ID NO: 74933 - DNA, 15 bp, Artificial Sequence
  dgRNA
  4930404N11Rik
agacccacgctctag

SEQ ID NO: 74934 - DNA, 15 bp, Artificial Sequence
  dgRNA
  4930404N11Rik
gacccacgctctaga

SEQ ID NO: 74935 - DNA, 15 bp, Artificial Sequence
  dgRNA
  4930404N11Rik
catgacctcccgctg

SEQ ID NO: 74936 - DNA, 15 bp, Artificial Sequence
  dgRNA
  4930404N11Rik
tgacctcccgctgtg

SEQ ID NO: 74937 - DNA, 15 bp, Artificial Sequence
  dgRNA
  Polr2m
ggtggttgaagtttc

SEQ ID NO: 74938 - DNA, 15 bp, Artificial Sequence
  dgRNA
  Polr2m
gggcgtattcagttg

SEQ ID NO: 74939 - DNA, 15 bp, Artificial Sequence
  dgRNA
  Polr2m
ggcgtattcagttga

SEQ ID NO: 74940 - DNA, 15 bp, Artificial Sequence
  dgRNA
  Polr2m
tgagggagtaattgc

SEQ ID NO: 74941 - DNA, 15 bp, Artificial Sequence
  dgRNA
  Ap3b1
gtgcccacgactctc

SEQ ID NO: 74942 - DNA, 15 bp, Artificial Sequence
  dgRNA
  Ap3b1
actctccggctgacc

SEQ ID NO: 74943 - DNA, 15 bp, Artificial Sequence
  dgRNA
  Ap3b1
ccgagtgtagcttcc

SEQ ID NO: 74944 - DNA, 15 bp, Artificial Sequence
  dgRNA
  Ap3b1
gcagcccctaacacc

SEQ ID NO: 74945 - DNA, 15 bp, Artificial Sequence
  dgRNA
  Il2
aggtgaaatccctct

SEQ ID NO: 74946 - DNA, 15 bp, Artificial Sequence
  dgRNA
  Il2
ttatactgttaatgc

SEQ ID NO: 74947 - DNA, 15 bp, Artificial Sequence
  dgRNA
  Ocln
ctagtgcccacctcc

SEQ ID NO: 74948 - DNA, 15 bp, Artificial Sequence
  dgRNA
  Ocln
ttccttaggcgacag

SEQ ID NO: 74949 - DNA, 15 bp, Artificial Sequence
  dgRNA
  Ocln
cttaggcgacagcgg

SEQ ID NO: 74950 - DNA, 15 bp, Artificial Sequence
  dgRNA
  Ocln
cagcggtggagttgc

SEQ ID NO: 74951 - DNA, 15 bp, Artificial Sequence
  dgRNA
  Cdr2l
gacgtaaataaaagt

SEQ ID NO: 74952 - DNA, 15 bp, Artificial Sequence
  dgRNA
  Cdr2l
aataaaagtcggacg

SEQ ID NO: 74953 - DNA, 15 bp, Artificial Sequence
  dgRNA
  Cdr2l
tgatccagcaattcc

SEQ ID NO: 74954 - DNA, 15 bp, Artificial Sequence
  dgRNA
  Cdr2l
agcaattcccggacc

SEQ ID NO: 74955 - DNA, 15 bp, Artificial Sequence
  dgRNA
  Nkx6-3
ggtctgtattctaat

SEQ ID NO: 74956 - DNA, 15 bp, Artificial Sequence
  dgRNA
  Nkx6-3
gccatatctttatca

SEQ ID NO: 74957 - DNA, 15 bp, Artificial Sequence
  dgRNA
  Nkx6-3
gcgctgtgtcgccat

SEQ ID NO: 74958 - DNA, 15 bp, Artificial Sequence
  dgRNA
  Dnaic2
cttgggtaggcattt

SEQ ID NO: 74959 - DNA, 15 bp, Artificial Sequence
  dgRNA
  Dnaic2
ggtgcttccgactag

SEQ ID NO: 74960 - DNA, 15 bp, Artificial Sequence
  dgRNA
  Dnaic2
gtgcttccgactagc

SEQ ID NO: 74961 - DNA, 15 bp, Artificial Sequence
  dgRNA
  Dnaic2
cgccttccgaactgc

SEQ ID NO: 74962 - DNA, 15 bp, Artificial Sequence
  dgRNA
  Ankar
taggacagctttagc

SEQ ID NO: 74963 - DNA, 15 bp, Artificial Sequence
  dgRNA
  Ankar
agctttagccggctc

SEQ ID NO: 74964 - DNA, 15 bp, Artificial Sequence
  dgRNA
  Ankar
gctttagccggctca

SEQ ID NO: 74965 - DNA, 15 bp, Artificial Sequence
  dgRNA
  Ankar
ctttagccggctcag

SEQ ID NO: 74966 - DNA, 15 bp, Artificial Sequence
  dgRNA
  1110059E24Rik
aggcgatcagggcac

SEQ ID NO: 74967 - DNA, 15 bp, Artificial Sequence
  dgRNA
  1110059E24Rik
tcacaaactgcgcag

SEQ ID NO: 74968 - DNA, 15 bp, Artificial Sequence
  dgRNA
  1110059E24Rik
ggagtcgctacgcta

SEQ ID NO: 74969 - DNA, 15 bp, Artificial Sequence
  dgRNA
  1110059E24Rik
gctacgctacggagc

SEQ ID NO: 74970 - DNA, 15 bp, Artificial Sequence
  dgRNA
  Gins1
acgcaatttactttc

SEQ ID NO: 74971 - DNA, 15 bp, Artificial Sequence
  dgRNA
  Gins1
ttggttgagcctatt

SEQ ID NO: 74972 - DNA, 15 bp, Artificial Sequence
  dgRNA
  Gins1
tgcgtctaagattgt

SEQ ID NO: 74973 - DNA, 15 bp, Artificial Sequence
  dgRNA
  Gins1
ttgcgtctaagattg

SEQ ID NO: 74974 - DNA, 15 bp, Artificial Sequence
  dgRNA
  Spdye4a
ttcaaaccggttgcc

SEQ ID NO: 74975 - DNA, 15 bp, Artificial Sequence
  dgRNA
  Spdye4a
aaccggttgccaggt

SEQ ID NO: 74976 - DNA, 15 bp, Artificial Sequence
  dgRNA
  Spdye4a
tccgcccctcctgat

SEQ ID NO: 74977 - DNA, 15 bp, Artificial Sequence
  dgRNA
  Spdye4a
gttggggaatgcaat

SEQ ID NO: 74978 - DNA, 15 bp, Artificial Sequence
  dgRNA
  Zfp651
ccagccgggtcggtc

SEQ ID NO: 74979 - DNA, 15 bp, Artificial Sequence
  dgRNA
  Zfp651
cagccgggtcggtcc

SEQ ID NO: 74980 - DNA, 15 bp, Artificial Sequence
  dgRNA
  Zfp651
agccgggtcggtccg

SEQ ID NO: 74981 - DNA, 15 bp, Artificial Sequence
  dgRNA
  Zfp651
ggtccggggaccccg

SEQ ID NO: 74982 - DNA, 15 bp, Artificial Sequence
  dgRNA
  Htra2
cgccgccatcttcgc

SEQ ID NO: 74983 - DNA, 15 bp, Artificial Sequence
  dgRNA
  Htra2
gccgccatcttcgca

SEQ ID NO: 74984 - DNA, 15 bp, Artificial Sequence
  dgRNA
  Htra2
atcttcgcagggccg

SEQ ID NO: 74985 - DNA, 15 bp, Artificial Sequence
  dgRNA
  Htra2
tcttcgcagggccgc

SEQ ID NO: 74986 - DNA, 15 bp, Artificial Sequence
  dgRNA
  Abcc8
caaatccacgcactc

SEQ ID NO: 74987 - DNA, 15 bp, Artificial Sequence
  dgRNA
  Abcc8
aaatccacgcactcc

SEQ ID NO: 74988 - DNA, 15 bp, Artificial Sequence
  dgRNA
  Abcc8
cactccgggctcacc

SEQ ID NO: 74989 - DNA, 15 bp, Artificial Sequence
  dgRNA
  Abcc8
tcacccggatcatct

SEQ ID NO: 74990 - DNA, 15 bp, Artificial Sequence
  dgRNA
  Ly6h
taacaaaagtcccta

SEQ ID NO: 74991 - DNA, 15 bp, Artificial Sequence
  dgRNA
  Ly6h
gggctgagttgccgg

SEQ ID NO: 74992 - DNA, 15 bp, Artificial Sequence
  dgRNA
  Ly6h
ggctgagttgccggt

SEQ ID NO: 74993 - DNA, 15 bp, Artificial Sequence
  dgRNA
  Ly6h
cggtgggcgtcgtca

SEQ ID NO: 74994 - DNA, 15 bp, Artificial Sequence
  dgRNA
  Ikbkg
caaattccaactaac

SEQ ID NO: 74995 - DNA, 15 bp, Artificial Sequence
  dgRNA
  Ikbkg
ttccaactaactggg

SEQ ID NO: 74996 - DNA, 15 bp, Artificial Sequence
  dgRNA
  Ikbkg
ctccagccaatgtgt

SEQ ID NO: 74997 - DNA, 15 bp, Artificial Sequence
  dgRNA
  Ikbkg
caccaacacattggc

SEQ ID NO: 74998 - DNA, 15 bp, Artificial Sequence
  dgRNA
  Apoc2
cgtacctccctcccc

SEQ ID NO: 74999 - DNA, 15 bp, Artificial Sequence
  dgRNA
  Apoc2
tggcacccacaataa

SEQ ID NO: 75000 - DNA, 15 bp, Artificial Sequence
  dgRNA
  Apoc2
gcatagcttctcttg

SEQ ID NO: 75001 - DNA, 15 bp, Artificial Sequence
  dgRNA
  Apoc2
ccttccgtcatatct

SEQ ID NO: 75002 - DNA, 15 bp, Artificial Sequence
  dgRNA
  Pald1
gttccctctacccta

SEQ ID NO: 75003 - DNA, 15 bp, Artificial Sequence
  dgRNA
  Pald1
ctagggttttcctcc

SEQ ID NO: 75004 - DNA, 15 bp, Artificial Sequence
  dgRNA
  Pald1
ttttcctccaggcgt

SEQ ID NO: 75005 - DNA, 15 bp, Artificial Sequence
  dgRNA
  Pald1
tttcctccaggcgta

SEQ ID NO: 75006 - DNA, 15 bp, Artificial Sequence
  dgRNA
  Usp14
agaacactcggccac

SEQ ID NO: 75007 - DNA, 15 bp, Artificial Sequence
  dgRNA
  Gm13078
cttcatcatcctatc

SEQ ID NO: 75008 - DNA, 15 bp, Artificial Sequence
  dgRNA
  Gm13078
catcatcctatcagg

SEQ ID NO: 75009 - DNA, 15 bp, Artificial Sequence
  dgRNA
  Gm13078
gtggctaaacatcag

SEQ ID NO: 75010 - DNA, 15 bp, Artificial Sequence
  dgRNA
  Gm13078
acatcagaggtttga

SEQ ID NO: 75011 - DNA, 15 bp, Artificial Sequence
  dgRNA
  Smad5
catcatccgggtccc

SEQ ID NO: 75012 - DNA, 15 bp, Artificial Sequence
  dgRNA
  Smad5
cgggtccccggcgag

SEQ ID NO: 75013 - DNA, 15 bp, Artificial Sequence
  dgRNA
  Smad5
gggtccccggcgagc

SEQ ID NO: 75014 - DNA, 15 bp, Artificial Sequence
  dgRNA
  Smad5
cggatgatgaggggg

SEQ ID NO: 75015 - DNA, 15 bp, Artificial Sequence
  dgRNA
  G3bp1
agaccatctgagtat

SEQ ID NO: 75016 - DNA, 15 bp, Artificial Sequence
  dgRNA
  G3bp1
atctgagtattggcg

SEQ ID NO: 75017 - DNA, 15 bp, Artificial Sequence
  dgRNA
  G3bp1
ggtttcgtgtccatc

SEQ ID NO: 75018 - DNA, 15 bp, Artificial Sequence
  dgRNA
  G3bp1
gtttcgtgtccatct

SEQ ID NO: 75019 - DNA, 15 bp, Artificial Sequence
  dgRNA
  Aadacl3
gtatgggccctggcc

SEQ ID NO: 75020 - DNA, 15 bp, Artificial Sequence
  dgRNA
  Aadacl3
catcttgactgggcg

SEQ ID NO: 75021 - DNA, 15 bp, Artificial Sequence
  dgRNA
  Aadacl3
ataaccttattcaga

SEQ ID NO: 75022 - DNA, 15 bp, Artificial Sequence
  dgRNA
  Dusp5
cgggccccccgagag

SEQ ID NO: 75023 - DNA, 15 bp, Artificial Sequence
  dgRNA
  Dusp5
gggccccccgagaga

SEQ ID NO: 75024 - DNA, 15 bp, Artificial Sequence
  dgRNA
  Dusp5
cgcaagctccaccca

SEQ ID NO: 75025 - DNA, 15 bp, Artificial Sequence
  dgRNA
  Dusp5
gcaagctccacccat

SEQ ID NO: 75026 - DNA, 15 bp, Artificial Sequence
  dgRNA
  Guca2b
agccctattcatgcc

SEQ ID NO: 75027 - DNA, 15 bp, Artificial Sequence
  dgRNA
  Guca2b
ggtctgccaagggcc

SEQ ID NO: 75028 - DNA, 15 bp, Artificial Sequence
  dgRNA
  Guca2b
aacatggtctgccaa

SEQ ID NO: 75029 - DNA, 15 bp, Artificial Sequence
  dgRNA
  Guca2b
aagaatccaagcttg

SEQ ID NO: 75030 - DNA, 15 bp, Artificial Sequence
  dgRNA
  Slc13a2
cccgctaagtcttcc

SEQ ID NO: 75031 - DNA, 15 bp, Artificial Sequence
  dgRNA
  Slc13a2
tgttactcctcccgc

SEQ ID NO: 75032 - DNA, 15 bp, Artificial Sequence
  dgRNA
  Slc13a2
aacactctgattgcc

SEQ ID NO: 75033 - DNA, 15 bp, Artificial Sequence
  dgRNA
  Slc13a2
tggttaacactcctc

SEQ ID NO: 75034 - DNA, 15 bp, Artificial Sequence
  dgRNA
  Pim1
gccgccgagccagcc

SEQ ID NO: 75035 - DNA, 15 bp, Artificial Sequence
  dgRNA
  Pim1
cccggctccccacct

SEQ ID NO: 75036 - DNA, 15 bp, Artificial Sequence
  dgRNA
  Pim1
ctcggcctcccggag

SEQ ID NO: 75037 - DNA, 15 bp, Artificial Sequence
  dgRNA
  Pim1
gcgcgccctccccag

SEQ ID NO: 75038 - DNA, 15 bp, Artificial Sequence
  dgRNA
  Tuba1a
aagtctacggatgct

SEQ ID NO: 75039 - DNA, 15 bp, Artificial Sequence
  dgRNA
  Tuba1a
agtctacggatgcta

SEQ ID NO: 75040 - DNA, 15 bp, Artificial Sequence
  dgRNA
  Tuba1a
gtctacggatgctag

SEQ ID NO: 75041 - DNA, 15 bp, Artificial Sequence
  dgRNA
  Tuba1a
tctacggatgctagg

SEQ ID NO: 75042 - DNA, 15 bp, Artificial Sequence
  dgRNA
  Ints6
gctaatgaggctgta

SEQ ID NO: 75043 - DNA, 15 bp, Artificial Sequence
  dgRNA
  Ints6
agccaatagggcagt

SEQ ID NO: 75044 - DNA, 15 bp, Artificial Sequence
  dgRNA
  Ints6
acccgagtacgtgtc

SEQ ID NO: 75045 - DNA, 15 bp, Artificial Sequence
  dgRNA
  Ints6
cccgagtacgtgtca

SEQ ID NO: 75046 - DNA, 15 bp, Artificial Sequence
  dgRNA
  Ccl5
gagtcatacttccaa

SEQ ID NO: 75047 - DNA, 15 bp, Artificial Sequence
  dgRNA
  Dgka
acagaagcgtaggag

SEQ ID NO: 75048 - DNA, 15 bp, Artificial Sequence
  dgRNA
  Dgka
cggagcagattgtgt

SEQ ID NO: 75049 - DNA, 15 bp, Artificial Sequence
  dgRNA
  Dgka
agctggcaacagcgg

SEQ ID NO: 75050 - DNA, 15 bp, Artificial Sequence
  dgRNA
  Dgka
caacagcggtgggct

SEQ ID NO: 75051 - DNA, 15 bp, Artificial Sequence
  dgRNA
  Ring1
ctttccggggttctc

SEQ ID NO: 75052 - DNA, 15 bp, Artificial Sequence
  dgRNA
  Ring1
cggggttctcaggcc

SEQ ID NO: 75053 - DNA, 15 bp, Artificial Sequence
  dgRNA
  Ring1
cggcttgagagaagt

SEQ ID NO: 75054 - DNA, 15 bp, Artificial Sequence
  dgRNA
  Ring1
ggatcagcgccacgg

SEQ ID NO: 75055 - DNA, 15 bp, Artificial Sequence
  dgRNA
  Lif
tttccaactgcgtcc

SEQ ID NO: 75056 - DNA, 15 bp, Artificial Sequence
  dgRNA
  Lif
ttccaactgcgtccc

SEQ ID NO: 75057 - DNA, 15 bp, Artificial Sequence
  dgRNA
  Lif
cccgggctgctccct

SEQ ID NO: 75058 - DNA, 15 bp, Artificial Sequence
  dgRNA
  Lif
ttgcaaactccggcc

SEQ ID NO: 75059 - DNA, 15 bp, Artificial Sequence
  dgRNA
  Gm13154
gtacgcttagaagaa

SEQ ID NO: 75060 - DNA, 15 bp, Artificial Sequence
  dgRNA
  Gm13154
aagcgtacctccttc

SEQ ID NO: 75061 - DNA, 15 bp, Artificial Sequence
  dgRNA
  Mdm2
gcctagcgaccattg

SEQ ID NO: 75062 - DNA, 15 bp, Artificial Sequence
  dgRNA
  Mdm2
cattgcggtttcgag

SEQ ID NO: 75063 - DNA, 15 bp, Artificial Sequence
  dgRNA
  Mdm2
gtaaacacaaccgcg

SEQ ID NO: 75064 - DNA, 15 bp, Artificial Sequence
  dgRNA
  Mdm2
acctcctgcgcgctc

SEQ ID NO: 75065 - DNA, 15 bp, Artificial Sequence
  dgRNA
  Slc5a1
ttttctgcctcacgt

SEQ ID NO: 75066 - DNA, 15 bp, Artificial Sequence
  dgRNA
  Slc5a1
tcacgtgggactccg

SEQ ID NO: 75067 - DNA, 15 bp, Artificial Sequence
  dgRNA
  Slc5a1
actccgtggcagacc

SEQ ID NO: 75068 - DNA, 15 bp, Artificial Sequence
  dgRNA
  Slc5a1
gtggcagaccaggcg

SEQ ID NO: 75069 - DNA, 15 bp, Artificial Sequence
  dgRNA
  Gsta4
ttaaccaacgtgcct

SEQ ID NO: 75070 - DNA, 15 bp, Artificial Sequence
  dgRNA
  Gsta4
taaccaacgtgccta

SEQ ID NO: 75071 - DNA, 15 bp, Artificial Sequence
  dgRNA
  Gsta4
aaccaacgtgcctag

SEQ ID NO: 75072 - DNA, 15 bp, Artificial Sequence
  dgRNA
  Gsta4
accaacgtgcctagg

SEQ ID NO: 75073 - DNA, 15 bp, Artificial Sequence
  dgRNA
  Fbxo27
ccaccagtcctaagc

SEQ ID NO: 75074 - DNA, 15 bp, Artificial Sequence
  dgRNA
  Fbxo27
cagtcctaagccgga

SEQ ID NO: 75075 - DNA, 15 bp, Artificial Sequence
  dgRNA
  Fbxo27
tcctaagccggaagg

SEQ ID NO: 75076 - DNA, 15 bp, Artificial Sequence
  dgRNA
  Fbxo27
taagccggaaggagg

SEQ ID NO: 75077 - DNA, 15 bp, Artificial Sequence
  dgRNA
  Rab3ip
gcccctcctgtcgcc

SEQ ID NO: 75078 - DNA, 15 bp, Artificial Sequence
  dgRNA
  Rab3ip
cccctcctgtcgcca

SEQ ID NO: 75079 - DNA, 15 bp, Artificial Sequence
  dgRNA
  Rab3ip
ccctcctgtcgccag

SEQ ID NO: 75080 - DNA, 15 bp, Artificial Sequence
  dgRNA
  Rab3ip
ctcgccactccctcc

SEQ ID NO: 75081 - DNA, 15 bp, Artificial Sequence
  dgRNA
  Pabpn1
gcatatttcacctac

SEQ ID NO: 75082 - DNA, 15 bp, Artificial Sequence
  dgRNA
  Pabpn1
catatttcacctacc

SEQ ID NO: 75083 - DNA, 15 bp, Artificial Sequence
  dgRNA
  Pabpn1
cgggtttagagaatt

SEQ ID NO: 75084 - DNA, 15 bp, Artificial Sequence
  dgRNA
  Pabpn1
agtggcccgccttag

SEQ ID NO: 75085 - DNA, 15 bp, Artificial Sequence
  dgRNA
  Ndufb10
agagcagttgttgac

SEQ ID NO: 75086 - DNA, 15 bp, Artificial Sequence
  dgRNA
  Ndufb10
ccctgctatcttagc

SEQ ID NO: 75087 - DNA, 15 bp, Artificial Sequence
  dgRNA
  Ndufb10
gctatcttagctggt

SEQ ID NO: 75088 - DNA, 15 bp, Artificial Sequence
  dgRNA
  Ndufb10
cttagctggtaggtc

SEQ ID NO: 75089 - DNA, 15 bp, Artificial Sequence
  dgRNA
  Kank2
agcggggaccctgtc

SEQ ID NO: 75090 - DNA, 15 bp, Artificial Sequence
  dgRNA
  Kank2
ggggaccctgtccgg

SEQ ID NO: 75091 - DNA, 15 bp, Artificial Sequence
  dgRNA
  Kank2
gggaccctgtccgga

SEQ ID NO: 75092 - DNA, 15 bp, Artificial Sequence
  dgRNA
  Kank2
ccctgtccggagggc

SEQ ID NO: 75093 - DNA, 15 bp, Artificial Sequence
  dgRNA
  Pelo
ctttgacgtttatct

SEQ ID NO: 75094 - DNA, 15 bp, Artificial Sequence
  dgRNA
  Pelo
tttgacgtttatcta

SEQ ID NO: 75095 - DNA, 15 bp, Artificial Sequence
  dgRNA
  Pelo
gcgcgcgccgccgac

SEQ ID NO: 75096 - DNA, 15 bp, Artificial Sequence
  dgRNA
  Pelo
cccgcctctctggta

SEQ ID NO: 75097 - DNA, 15 bp, Artificial Sequence
  dgRNA
  Grip1
tataatagtgtgcca

SEQ ID NO: 75098 - DNA, 15 bp, Artificial Sequence
  dgRNA
  Grip1
tactgtgagaaggtc

SEQ ID NO: 75099 - DNA, 15 bp, Artificial Sequence
  dgRNA
  Grip1
gaattccatgactcc

SEQ ID NO: 75100 - DNA, 15 bp, Artificial Sequence
  dgRNA
  Grip1
caacctatgtcacag

SEQ ID NO: 75101 - DNA, 15 bp, Artificial Sequence
  dgRNA
  Snrpb2
aacttcctagcccac

SEQ ID NO: 75102 - DNA, 15 bp, Artificial Sequence
  dgRNA
  Snrpb2
agaaagattccgcct

SEQ ID NO: 75103 - DNA, 15 bp, Artificial Sequence
  dgRNA
  Snrpb2
agattccgccttggc

SEQ ID NO: 75104 - DNA, 15 bp, Artificial Sequence
  dgRNA
  Snrpb2
tccgccttggccggc

SEQ ID NO: 75105 - DNA, 15 bp, Artificial Sequence
  dgRNA
  Rgs22
tgcggtccttcgctg

SEQ ID NO: 75106 - DNA, 15 bp, Artificial Sequence
  dgRNA
  Rgs22
gcggtccttcgctgt

SEQ ID NO: 75107 - DNA, 15 bp, Artificial Sequence
  dgRNA
  Rgs22
gtccttcgctgtggg

SEQ ID NO: 75108 - DNA, 15 bp, Artificial Sequence
  dgRNA
  Rgs22
cgatctccacagtaa

SEQ ID NO: 75109 - DNA, 15 bp, Artificial Sequence
  dgRNA
  Morc2a
acttttgatgtgcgt

SEQ ID NO: 75110 - DNA, 15 bp, Artificial Sequence
  dgRNA
  Morc2a
cccccggagcactta

SEQ ID NO: 75111 - DNA, 15 bp, Artificial Sequence
  dgRNA
  Morc2a
gcacttaaggacagt

SEQ ID NO: 75112 - DNA, 15 bp, Artificial Sequence
  dgRNA
  Morc2a
gtgaacggttctgaa

SEQ ID NO: 75113 - DNA, 15 bp, Artificial Sequence
  dgRNA
  Tmco5
agtatgtccatgctt

SEQ ID NO: 75114 - DNA, 15 bp, Artificial Sequence
  dgRNA
  Tmco5
gtatgtccatgctta

SEQ ID NO: 75115 - DNA, 15 bp, Artificial Sequence
  dgRNA
  Tmco5
tgcttgcccgtcctg

SEQ ID NO: 75116 - DNA, 15 bp, Artificial Sequence
  dgRNA
  Tmco5
ggagtcataacccta

SEQ ID NO: 75117 - DNA, 15 bp, Artificial Sequence
  dgRNA
  Vmn2r23
taaacttgacccaca

SEQ ID NO: 75118 - DNA, 15 bp, Artificial Sequence
  dgRNA
  Vmn2r23
ttgttgacgtgctat

SEQ ID NO: 75119 - DNA, 15 bp, Artificial Sequence
  dgRNA
  Vmn2r23
tgttgacgtgctatt

SEQ ID NO: 75120 - DNA, 15 bp, Artificial Sequence
  dgRNA
  Vmn2r23
atcttaacagatctc

SEQ ID NO: 75121 - DNA, 15 bp, Artificial Sequence
  dgRNA
  Elp5
ctccgccagcccccc

SEQ ID NO: 75122 - DNA, 15 bp, Artificial Sequence
  dgRNA
  Elp5
tccgccagccccccg

SEQ ID NO: 75123 - DNA, 15 bp, Artificial Sequence
  dgRNA
  Elp5
ccgccagccccccgg

SEQ ID NO: 75124 - DNA, 15 bp, Artificial Sequence
  dgRNA
  Elp5
gcagccccccgccgc

SEQ ID NO: 75125 - DNA, 15 bp, Artificial Sequence
  dgRNA
  Shisa5
ctagccttcttttag

SEQ ID NO: 75126 - DNA, 15 bp, Artificial Sequence
  dgRNA
  Shisa5
aaagtgtcacccctg

SEQ ID NO: 75127 - DNA, 15 bp, Artificial Sequence
  dgRNA
  Shisa5
gtgtctttaagaggg

SEQ ID NO: 75128 - DNA, 15 bp, Artificial Sequence
  dgRNA
  Cdkn2aip
ccgctgaagtcgcct

SEQ ID NO: 75129 - DNA, 15 bp, Artificial Sequence
  dgRNA
  Cdkn2aip
cgccgagcgagtcgc

SEQ ID NO: 75130 - DNA, 15 bp, Artificial Sequence
  dgRNA
  Cdkn2aip
cgagtcgctggcgac

SEQ ID NO: 75131 - DNA, 15 bp, Artificial Sequence
  dgRNA
  Cdkn2aip
gagtcgctggcgact

SEQ ID NO: 75132 - DNA, 15 bp, Artificial Sequence
  dgRNA
  Gm597
cagatctgacctttc

SEQ ID NO: 75133 - DNA, 15 bp, Artificial Sequence
  dgRNA
  Vmn2r65
agcacattgatactt

SEQ ID NO: 75134 - DNA, 15 bp, Artificial Sequence
  dgRNA
  Vmn2r65
tactgcacttgactc

SEQ ID NO: 75135 - DNA, 15 bp, Artificial Sequence
  dgRNA
  Vmn2r65
agcactttctatccc

SEQ ID NO: 75136 - DNA, 15 bp, Artificial Sequence
  dgRNA
  Vmn2r65
catgttatcctctgg

SEQ ID NO: 75137 - DNA, 15 bp, Artificial Sequence
  dgRNA
  Atp6v0a2
ctctaaaagcagcgc

SEQ ID NO: 75138 - DNA, 15 bp, Artificial Sequence
  dgRNA
  Atp6v0a2
tctaaaagcagcgca

SEQ ID NO: 75139 - DNA, 15 bp, Artificial Sequence
  dgRNA
  Atp6v0a2
aggggtcacccaatt

SEQ ID NO: 75140 - DNA, 15 bp, Artificial Sequence
  dgRNA
  Atp6v0a2
ggggtcacccaatta

SEQ ID NO: 75141 - DNA, 15 bp, Artificial Sequence
  dgRNA
  Mtfr1
ctagctcctttcagc

SEQ ID NO: 75142 - DNA, 15 bp, Artificial Sequence
  dgRNA
  Mtfr1
atttgagacttcact

SEQ ID NO: 75143 - DNA, 15 bp, Artificial Sequence
  dgRNA
  Mtfr1
acttcactcggaatg

SEQ ID NO: 75144 - DNA, 15 bp, Artificial Sequence
  dgRNA
  Mtfr1
cttcactcggaatgt

SEQ ID NO: 75145 - DNA, 15 bp, Artificial Sequence
  dgRNA
  Smyd2
tgtctgcgggcacag

SEQ ID NO: 75146 - DNA, 15 bp, Artificial Sequence
  dgRNA
  Smyd2
gtctgcgggcacagc

SEQ ID NO: 75147 - DNA, 15 bp, Artificial Sequence
  dgRNA
  Smyd2
tgcgggcacagcggg

SEQ ID NO: 75148 - DNA, 15 bp, Artificial Sequence
  dgRNA
  Smyd2
cagcgggtggtggcc

SEQ ID NO: 75149 - DNA, 15 bp, Artificial Sequence
  dgRNA
  Xiap
agcatagtatacact

SEQ ID NO: 75150 - DNA, 15 bp, Artificial Sequence
  dgRNA
  Xiap
gtatctagaactaaa

SEQ ID NO: 75151 - DNA, 15 bp, Artificial Sequence
  dgRNA
  Xiap
ttgcagactttggac

SEQ ID NO: 75152 - DNA, 15 bp, Artificial Sequence
  dgRNA
  Tceb2
acccagacaccgaga

SEQ ID NO: 75153 - DNA, 15 bp, Artificial Sequence
  dgRNA
  Tceb2
atggcggccaagcac

SEQ ID NO: 75154 - DNA, 15 bp, Artificial Sequence
  dgRNA
  Tceb2
ccggatcgcttaaga

SEQ ID NO: 75155 - DNA, 15 bp, Artificial Sequence
  dgRNA
  Tceb2
ttaagatggccgcaa

SEQ ID NO: 75156 - DNA, 15 bp, Artificial Sequence
  dgRNA
  Il6ra
cgatctgagccacgc

SEQ ID NO: 75157 - DNA, 15 bp, Artificial Sequence
  dgRNA
  Il6ra
gatctgagccacgcc

SEQ ID NO: 75158 - DNA, 15 bp, Artificial Sequence
  dgRNA
  Il6ra
atctgagccacgccg

SEQ ID NO: 75159 - DNA, 15 bp, Artificial Sequence
  dgRNA
  Il6ra
ggctcagatcggtgt

SEQ ID NO: 75160 - DNA, 15 bp, Artificial Sequence
  dgRNA
  Sppl3
accactgcgcgccca

SEQ ID NO: 75161 - DNA, 15 bp, Artificial Sequence
  dgRNA
  Sppl3
ccactgcgcgcccaa

SEQ ID NO: 75162 - DNA, 15 bp, Artificial Sequence
  dgRNA
  Sppl3
cactgcgcgcccaag

SEQ ID NO: 75163 - DNA, 15 bp, Artificial Sequence
  dgRNA
  Sppl3
aaggggcctagcgcg

SEQ ID NO: 75164 - DNA, 15 bp, Artificial Sequence
  dgRNA
  Olfr159
aggtgttgttcgttc

SEQ ID NO: 75165 - DNA, 15 bp, Artificial Sequence
  dgRNA
  Olfr159
ggtgttgttcgttca

SEQ ID NO: 75166 - DNA, 15 bp, Artificial Sequence
  dgRNA
  Olfr159
ttcccttggcgttat

SEQ ID NO: 75167 - DNA, 15 bp, Artificial Sequence
  dgRNA
  Olfr159
acaacacctgcttgg

SEQ ID NO: 75168 - DNA, 15 bp, Artificial Sequence
  dgRNA
  Olfr597
tttgctaaaaaaagc

SEQ ID NO: 75169 - DNA, 15 bp, Artificial Sequence
  dgRNA
  Olfr597
ggttgaatgctactc

SEQ ID NO: 75170 - DNA, 15 bp, Artificial Sequence
  dgRNA
  Ormdl2
cccattagtcagcgg

SEQ ID NO: 75171 - DNA, 15 bp, Artificial Sequence
  dgRNA
  Ormdl2
attagtcagcggcgg

SEQ ID NO: 75172 - DNA, 15 bp, Artificial Sequence
  dgRNA
  Ormdl2
cgctctcacgcctct

SEQ ID NO: 75173 - DNA, 15 bp, Artificial Sequence
  dgRNA
  Ormdl2
cacggctctctaaaa

SEQ ID NO: 75174 - DNA, 15 bp, Artificial Sequence
  dgRNA
  Cmbl
ttccatccgggagcc

SEQ ID NO: 75175 - DNA, 15 bp, Artificial Sequence
  dgRNA
  Cmbl
tccagccccttctcg

SEQ ID NO: 75176 - DNA, 15 bp, Artificial Sequence
  dgRNA
  Cmbl
ttctcgcggtccttg

SEQ ID NO: 75177 - DNA, 15 bp, Artificial Sequence
  dgRNA
  Cmbl
tcccccggcttttcc

SEQ ID NO: 75178 - DNA, 15 bp, Artificial Sequence
  dgRNA
  Gm12185
agcccccctcttagg

SEQ ID NO: 75179 - DNA, 15 bp, Artificial Sequence
  dgRNA
  Gm12185
aaccacctaagaggg

SEQ ID NO: 75180 - DNA, 15 bp, Artificial Sequence
  dgRNA
  Fndc3b
tgccgggctgtgacc

SEQ ID NO: 75181 - DNA, 15 bp, Artificial Sequence
  dgRNA
  Fndc3b
gccgggctgtgaccc

SEQ ID NO: 75182 - DNA, 15 bp, Artificial Sequence
  dgRNA
  Fndc3b
ctgtgacccgggacc

SEQ ID NO: 75183 - DNA, 15 bp, Artificial Sequence
  dgRNA
  Fndc3b
tgtgacccgggaccc

SEQ ID NO: 75184 - DNA, 15 bp, Artificial Sequence
  dgRNA
  Rnf128
tgtgacccttttaag

SEQ ID NO: 75185 - DNA, 15 bp, Artificial Sequence
  dgRNA
  Rnf128
gacccttttaagagg

SEQ ID NO: 75186 - DNA, 15 bp, Artificial Sequence
  dgRNA
  Rnf128
ctacccccagccggg

SEQ ID NO: 75187 - DNA, 15 bp, Artificial Sequence
  dgRNA
  Rnf128
tacccccagccgggt

SEQ ID NO: 75188 - DNA, 15 bp, Artificial Sequence
  dgRNA
  Artn
agccctgtcgctccg

SEQ ID NO: 75189 - DNA, 15 bp, Artificial Sequence
  dgRNA
  Artn
cggagtcaccacttg

SEQ ID NO: 75190 - DNA, 15 bp, Artificial Sequence
  dgRNA
  Artn
ctgcgcagcccaagt

SEQ ID NO: 75191 - DNA, 15 bp, Artificial Sequence
  dgRNA
  Artn
ttggaactctccttc

SEQ ID NO: 75192 - DNA, 15 bp, Artificial Sequence
  dgRNA
  Slfn9
gtaagttcttgctat

SEQ ID NO: 75193 - DNA, 15 bp, Artificial Sequence
  dgRNA
  Slfn9
taagttcttgctata

SEQ ID NO: 75194 - DNA, 15 bp, Artificial Sequence
  dgRNA
  Slfn9
agccgcccacagcca

SEQ ID NO: 75195 - DNA, 15 bp, Artificial Sequence
  dgRNA
  Slfn9
ggatgggggcttatc

SEQ ID NO: 75196 - DNA, 15 bp, Artificial Sequence
  dgRNA
  Rgs7
ccgcgcgcgctcgac

SEQ ID NO: 75197 - DNA, 15 bp, Artificial Sequence
  dgRNA
  Rgs7
acgagcgaggcggcc

SEQ ID NO: 75198 - DNA, 15 bp, Artificial Sequence
  dgRNA
  Rgs7
cgagcgaggcggccc

SEQ ID NO: 75199 - DNA, 15 bp, Artificial Sequence
  dgRNA
  Rgs7
gagcgaggcggcccg

SEQ ID NO: 75200 - DNA, 15 bp, Artificial Sequence
  dgRNA
  Klrb1b
cgtacgttctgtatg

SEQ ID NO: 75201 - DNA, 15 bp, Artificial Sequence
  dgRNA
  Klrb1b
ccaggtcaatagcta

SEQ ID NO: 75202 - DNA, 15 bp, Artificial Sequence
  dgRNA
  Klrb1b
acagaacgtacggtt

SEQ ID NO: 75203 - DNA, 15 bp, Artificial Sequence
  dgRNA
  Klrb1b
cacatacagaacgta

SEQ ID NO: 75204 - DNA, 15 bp, Artificial Sequence
  dgRNA
  Igf1
agaattcccgattct

SEQ ID NO: 75205 - DNA, 15 bp, Artificial Sequence
  dgRNA
  Eps8l2
ccgcaccctgttctc

SEQ ID NO: 75206 - DNA, 15 bp, Artificial Sequence
  dgRNA
  Eps8l2
cgcaccctgttctcc

SEQ ID NO: 75207 - DNA, 15 bp, Artificial Sequence
  dgRNA
  Eps8l2
gcaccctgttctccg

SEQ ID NO: 75208 - DNA, 15 bp, Artificial Sequence
  dgRNA
  Eps8l2
cggggccagctgcaa

SEQ ID NO: 75209 - DNA, 15 bp, Artificial Sequence
  dgRNA
  Olfr575
tctctccggcatatg

SEQ ID NO: 75210 - DNA, 15 bp, Artificial Sequence
  dgRNA
  Olfr575
ttttaccacatatgc

SEQ ID NO: 75211 - DNA, 15 bp, Artificial Sequence
  dgRNA
  Olfr575
cgtagagatctgaat

SEQ ID NO: 75212 - DNA, 15 bp, Artificial Sequence
  dgRNA
  Stbd1
tggcgtgggataaag

SEQ ID NO: 75213 - DNA, 15 bp, Artificial Sequence
  dgRNA
  Stbd1
gggataaagtggagc

SEQ ID NO: 75214 - DNA, 15 bp, Artificial Sequence
  dgRNA
  Stbd1
aagtggagcgggacc

SEQ ID NO: 75215 - DNA, 15 bp, Artificial Sequence
  dgRNA
  Stbd1
ggccggcagcggtga

SEQ ID NO: 75216 - DNA, 15 bp, Artificial Sequence
  dgRNA
  Tha1
tctcagcatgctgcg

SEQ ID NO: 75217 - DNA, 15 bp, Artificial Sequence
  dgRNA
  Tha1
cagttcaggtccgcg

SEQ ID NO: 75218 - DNA, 15 bp, Artificial Sequence
  dgRNA
  Tha1
agttcaggtccgcgc

SEQ ID NO: 75219 - DNA, 15 bp, Artificial Sequence
  dgRNA
  Tha1
gttcaggtccgcgcg

SEQ ID NO: 75220 - DNA, 15 bp, Artificial Sequence
  dgRNA
  Dand5
tgaataggggtctga

SEQ ID NO: 75221 - DNA, 15 bp, Artificial Sequence
  dgRNA
  Dand5
aggctcagccccccc

SEQ ID NO: 75222 - DNA, 15 bp, Artificial Sequence
  dgRNA
  Ift43
ttggagcaatgttag

SEQ ID NO: 75223 - DNA, 15 bp, Artificial Sequence
  dgRNA
  Ift43
gaggatcttgctagc

SEQ ID NO: 75224 - DNA, 15 bp, Artificial Sequence
  dgRNA
  Ift43
ggtgtaggcaagatt

SEQ ID NO: 75225 - DNA, 15 bp, Artificial Sequence
  dgRNA
  Ift43
agatttggtttcaac

SEQ ID NO: 75226 - DNA, 15 bp, Artificial Sequence
  dgRNA
  Dnajb1
agagagggttgcgat

SEQ ID NO: 75227 - DNA, 15 bp, Artificial Sequence
  dgRNA
  Dnajb1
agggttgcgattggc

SEQ ID NO: 75228 - DNA, 15 bp, Artificial Sequence
  dgRNA
  Dnajb1
tggctggatccgcta

SEQ ID NO: 75229 - DNA, 15 bp, Artificial Sequence
  dgRNA
  Dnajb1
ctggatccgctacgg

SEQ ID NO: 75230 - DNA, 15 bp, Artificial Sequence
  dgRNA
  Epb41l2
gggtcctagtgttag

SEQ ID NO: 75231 - DNA, 15 bp, Artificial Sequence
  dgRNA
  Epb41l2
tagtggcactattcc

SEQ ID NO: 75232 - DNA, 15 bp, Artificial Sequence
  dgRNA
  Epb41l2
gcactattcctggcc

SEQ ID NO: 75233 - DNA, 15 bp, Artificial Sequence
  dgRNA
  Epb41l2
ctctgacttaagcgc

SEQ ID NO: 75234 - DNA, 15 bp, Artificial Sequence
  dgRNA
  Tmem52
aagctgagccggtgt

SEQ ID NO: 75235 - DNA, 15 bp, Artificial Sequence
  dgRNA
  Tmem52
aactcagtccaacac

SEQ ID NO: 75236 - DNA, 15 bp, Artificial Sequence
  dgRNA
  Stmn1
cacccacgctagtcc

SEQ ID NO: 75237 - DNA, 15 bp, Artificial Sequence
  dgRNA
  Stmn1
gctctccaggcttcg

SEQ ID NO: 75238 - DNA, 15 bp, Artificial Sequence
  dgRNA
  Stmn1
tttggctgcggccgc

SEQ ID NO: 75239 - DNA, 15 bp, Artificial Sequence
  dgRNA
  Stmn1
gatcggaagagcatt

SEQ ID NO: 75240 - DNA, 15 bp, Artificial Sequence
  dgRNA
  Serpina1c
cccccatatccatct

SEQ ID NO: 75241 - DNA, 15 bp, Artificial Sequence
  dgRNA
  Serpina1c
ctaagttcatcgatt

SEQ ID NO: 75242 - DNA, 15 bp, Artificial Sequence
  dgRNA
  Serpina1c
gctaagttcatcgat

SEQ ID NO: 75243 - DNA, 15 bp, Artificial Sequence
  dgRNA
  Serpina1c
gccaagatggatatg

SEQ ID NO: 75244 - DNA, 15 bp, Artificial Sequence
  dgRNA
  Phc2
attgcagcgttgtgc

SEQ ID NO: 75245 - DNA, 15 bp, Artificial Sequence
  dgRNA
  Phc2
attgcagggtaacac

SEQ ID NO: 75246 - DNA, 15 bp, Artificial Sequence
  dgRNA
  Phc2
catactctgggttgg

SEQ ID NO: 75247 - DNA, 15 bp, Artificial Sequence
  dgRNA
  Cyp4f17
ggctccaattgcttc

SEQ ID NO: 75248 - DNA, 15 bp, Artificial Sequence
  dgRNA
  Cyp4f17
ccaattgcttcgggt

SEQ ID NO: 75249 - DNA, 15 bp, Artificial Sequence
  dgRNA
  Cyp4f17
tttgatattctaccc

SEQ ID NO: 75250 - DNA, 15 bp, Artificial Sequence
  dgRNA
  Cyp4f17
atattctacccaggc

SEQ ID NO: 75251 - DNA, 15 bp, Artificial Sequence
  dgRNA
  Prr23a2
tcttaagcataggct

SEQ ID NO: 75252 - DNA, 15 bp, Artificial Sequence
  dgRNA
  Prr23a2
cataggctaggctat

SEQ ID NO: 75253 - DNA, 15 bp, Artificial Sequence
  dgRNA
  Prr23a2
ataggctaggctatt

SEQ ID NO: 75254 - DNA, 15 bp, Artificial Sequence
  dgRNA
  Prr23a2
ctagtatgccactcc

SEQ ID NO: 75255 - DNA, 15 bp, Artificial Sequence
  dgRNA
  1600002K03Rik
gggttgcctgaataa

SEQ ID NO: 75256 - DNA, 15 bp, Artificial Sequence
  dgRNA
  1600002K03Rik
ggttgcctgaataaa

SEQ ID NO: 75257 - DNA, 15 bp, Artificial Sequence
  dgRNA
  1600002K03Rik
gaacccccgactctg

SEQ ID NO: 75258 - DNA, 15 bp, Artificial Sequence
  dgRNA
  1600002K03Rik
cccgactctgtggct

SEQ ID NO: 75259 - DNA, 15 bp, Artificial Sequence
  dgRNA
  Sorbs3
ccttcggcagctcag

SEQ ID NO: 75260 - DNA, 15 bp, Artificial Sequence
  dgRNA
  Sorbs3
tctagtaaacagtct

SEQ ID NO: 75261 - DNA, 15 bp, Artificial Sequence
  dgRNA
  Sorbs3
ccgctgagctgccga

SEQ ID NO: 75262 - DNA, 15 bp, Artificial Sequence
  dgRNA
  Apobec1
tctcaaggattttcg

SEQ ID NO: 75263 - DNA, 15 bp, Artificial Sequence
  dgRNA
  Apobec1
ctcaaggattttcgg

SEQ ID NO: 75264 - DNA, 15 bp, Artificial Sequence
  dgRNA
  Apobec1
tcaaggattttcggg

SEQ ID NO: 75265 - DNA, 15 bp, Artificial Sequence
  dgRNA
  Apobec1
gggaagcggccgaat

SEQ ID NO: 75266 - DNA, 15 bp, Artificial Sequence
  dgRNA
  Gm6583
cagccgacacagtgt

SEQ ID NO: 75267 - DNA, 15 bp, Artificial Sequence
  dgRNA
  Gm6583
aggtcacgggtgcaa

SEQ ID NO: 75268 - DNA, 15 bp, Artificial Sequence
  dgRNA
  Gm6583
ggtcacgggtgcaaa

SEQ ID NO: 75269 - DNA, 15 bp, Artificial Sequence
  dgRNA
  Gm6583
aagggtcttcaaggc

SEQ ID NO: 75270 - DNA, 15 bp, Artificial Sequence
  dgRNA
  Coro1b
cacagtctgtacccg

SEQ ID NO: 75271 - DNA, 15 bp, Artificial Sequence
  dgRNA
  Coro1b
cccgcggctccaagc

SEQ ID NO: 75272 - DNA, 15 bp, Artificial Sequence
  dgRNA
  Coro1b
cagggcctggcgact

SEQ ID NO: 75273 - DNA, 15 bp, Artificial Sequence
  dgRNA
  Coro1b
ctaggccttgccccg

SEQ ID NO: 75274 - DNA, 15 bp, Artificial Sequence
  dgRNA
  Ppt2
actctccgtgtgtcc

SEQ ID NO: 75275 - DNA, 15 bp, Artificial Sequence
  dgRNA
  Ppt2
tcccagagtagtgaa

SEQ ID NO: 75276 - DNA, 15 bp, Artificial Sequence
  dgRNA
  Ppt2
agtagtgaatggccg

SEQ ID NO: 75277 - DNA, 15 bp, Artificial Sequence
  dgRNA
  Ppt2
ccgaggtgatgctta

SEQ ID NO: 75278 - DNA, 15 bp, Artificial Sequence
  dgRNA
  Csgalnact1
aggctcagcggctgt

SEQ ID NO: 75279 - DNA, 15 bp, Artificial Sequence
  dgRNA
  Csgalnact1
agcggctgttggaac

SEQ ID NO: 75280 - DNA, 15 bp, Artificial Sequence
  dgRNA
  Csgalnact1
gccgctgagcctcca

SEQ ID NO: 75281 - DNA, 15 bp, Artificial Sequence
  dgRNA
  Snca
catctgggctcgtcc

SEQ ID NO: 75282 - DNA, 15 bp, Artificial Sequence
  dgRNA
  Snca
gagggggtcgcctag

SEQ ID NO: 75283 - DNA, 15 bp, Artificial Sequence
  dgRNA
  Snca
gtcgcctagaggaac

SEQ ID NO: 75284 - DNA, 15 bp, Artificial Sequence
  dgRNA
  Snca
tcgcctagaggaact

SEQ ID NO: 75285 - DNA, 15 bp, Artificial Sequence
  dgRNA
  Gm10229
ggcacaagcccatag

SEQ ID NO: 75286 - DNA, 15 bp, Artificial Sequence
  dgRNA
  Gm10229
gcacaagcccatagt

SEQ ID NO: 75287 - DNA, 15 bp, Artificial Sequence
  dgRNA
  Gm10229
aaagggcctccactc

SEQ ID NO: 75288 - DNA, 15 bp, Artificial Sequence
  dgRNA
  Gm10229
gttacaggtaacact

SEQ ID NO: 75289 - DNA, 15 bp, Artificial Sequence
  dgRNA
  Map3k9
ggagacggacagccg

SEQ ID NO: 75290 - DNA, 15 bp, Artificial Sequence
  dgRNA
  Map3k9
gacggacagccgcgg

SEQ ID NO: 75291 - DNA, 15 bp, Artificial Sequence
  dgRNA
  Map3k9
acggacagccgcggc

SEQ ID NO: 75292 - DNA, 15 bp, Artificial Sequence
  dgRNA
  Map3k9
gccgcggcgggccaa

SEQ ID NO: 75293 - DNA, 15 bp, Artificial Sequence
  dgRNA
  Orm2
agggccggctggccg

SEQ ID NO: 75294 - DNA, 15 bp, Artificial Sequence
  dgRNA
  Orm2
atgtggcgagggcat

SEQ ID NO: 75295 - DNA, 15 bp, Artificial Sequence
  dgRNA
  Orm2
gatgtggcgagggca

SEQ ID NO: 75296 - DNA, 15 bp, Artificial Sequence
  dgRNA
  Orm2
taatagatgtggcga

SEQ ID NO: 75297 - DNA, 15 bp, Artificial Sequence
  dgRNA
  Unc5c
tccaccttccgcgcg

SEQ ID NO: 75298 - DNA, 15 bp, Artificial Sequence
  dgRNA
  Unc5c
cttccgcgcgaggcg

SEQ ID NO: 75299 - DNA, 15 bp, Artificial Sequence
  dgRNA
  Unc5c
atcctcgcttacata

SEQ ID NO: 75300 - DNA, 15 bp, Artificial Sequence
  dgRNA
  Unc5c
ctcgcttacataagg

SEQ ID NO: 75301 - DNA, 15 bp, Artificial Sequence
  dgRNA
  Uba3
gcttcaggggacgag

SEQ ID NO: 75302 - DNA, 15 bp, Artificial Sequence
  dgRNA
  Uba3
gaggcgcggcttcag

SEQ ID NO: 75303 - DNA, 15 bp, Artificial Sequence
  dgRNA
  Uba3
agaggcgcggcttca

SEQ ID NO: 75304 - DNA, 15 bp, Artificial Sequence
  dgRNA
  Uba3
tagaggcgcggcttc

SEQ ID NO: 75305 - DNA, 15 bp, Artificial Sequence
  dgRNA
  Fbxo17
tggcagccacgtttc

SEQ ID NO: 75306 - DNA, 15 bp, Artificial Sequence
  dgRNA
  Fbxo17
ggcagccacgtttca

SEQ ID NO: 75307 - DNA, 15 bp, Artificial Sequence
  dgRNA
  Fbxo17
ccacgtttcagggac

SEQ ID NO: 75308 - DNA, 15 bp, Artificial Sequence
  dgRNA
  Fbxo17
cgtttcagggacagg

SEQ ID NO: 75309 - DNA, 15 bp, Artificial Sequence
  dgRNA
  Lztr1
atatacgataatgcg

SEQ ID NO: 75310 - DNA, 15 bp, Artificial Sequence
  dgRNA
  Lztr1
gataatgcgaggagc

SEQ ID NO: 75311 - DNA, 15 bp, Artificial Sequence
  dgRNA
  Lztr1
ataatgcgaggagcc

SEQ ID NO: 75312 - DNA, 15 bp, Artificial Sequence
  dgRNA
  Lztr1
tagcgagccgcgtcg

SEQ ID NO: 75313 - DNA, 15 bp, Artificial Sequence
  dgRNA
  Scly
cgctttgccgatgac

SEQ ID NO: 75314 - DNA, 15 bp, Artificial Sequence
  dgRNA
  Scly
gatgaccggttagat

SEQ ID NO: 75315 - DNA, 15 bp, Artificial Sequence
  dgRNA
  Scly
ccggttagataggac

SEQ ID NO: 75316 - DNA, 15 bp, Artificial Sequence
  dgRNA
  Scly
ataggaccggcagcg

SEQ ID NO: 75317 - DNA, 15 bp, Artificial Sequence
  dgRNA
  Phactr3
tcccaccatcgctcg

SEQ ID NO: 75318 - DNA, 15 bp, Artificial Sequence
  dgRNA
  Phactr3
ctcgaggcaatgtcc

SEQ ID NO: 75319 - DNA, 15 bp, Artificial Sequence
  dgRNA
  Phactr3
gcctccgccctgaga

SEQ ID NO: 75320 - DNA, 15 bp, Artificial Sequence
  dgRNA
  Phactr3
cctccgccctgagaa

SEQ ID NO: 75321 - DNA, 15 bp, Artificial Sequence
  dgRNA
  Klhl31
gactcaatggatgcg

SEQ ID NO: 75322 - DNA, 15 bp, Artificial Sequence
  dgRNA
  Klhl31
ttgggtttcttgacc

SEQ ID NO: 75323 - DNA, 15 bp, Artificial Sequence
  dgRNA
  Klhl31
cggtgccctggttgg

SEQ ID NO: 75324 - DNA, 15 bp, Artificial Sequence
  dgRNA
  Klhl31
gggcggtgccctggt

SEQ ID NO: 75325 - DNA, 15 bp, Artificial Sequence
  dgRNA
  Med10
cccgcccatagcgcc

SEQ ID NO: 75326 - DNA, 15 bp, Artificial Sequence
  dgRNA
  Med10
ccgcccatagcgccc

SEQ ID NO: 75327 - DNA, 15 bp, Artificial Sequence
  dgRNA
  Med10
tccggaagccggaag

SEQ ID NO: 75328 - DNA, 15 bp, Artificial Sequence
  dgRNA
  Med10
tgggaaatgttaacc

SEQ ID NO: 75329 - DNA, 15 bp, Artificial Sequence
  dgRNA
  Zfp36l3
tcatcctccacttgg

SEQ ID NO: 75330 - DNA, 15 bp, Artificial Sequence
  dgRNA
  Zfp36l3
tacgccaccaagtgg

SEQ ID NO: 75331 - DNA, 15 bp, Artificial Sequence
  dgRNA
  Zfp36l3
aggtacgccaccaag

SEQ ID NO: 75332 - DNA, 15 bp, Artificial Sequence
  dgRNA
  Zfp36l3
gtacgtaagatgtgc

SEQ ID NO: 75333 - DNA, 15 bp, Artificial Sequence
  dgRNA
  Olfr319
tctggactagctgta

SEQ ID NO: 75334 - DNA, 15 bp, Artificial Sequence
  dgRNA
  Olfr319
ttctggactagctgt

SEQ ID NO: 75335 - DNA, 15 bp, Artificial Sequence
  dgRNA
  Clvs1
ctgtattgccagaat

SEQ ID NO: 75336 - DNA, 15 bp, Artificial Sequence
  dgRNA
  Clvs1
gagtccaacctgcgg

SEQ ID NO: 75337 - DNA, 15 bp, Artificial Sequence
  dgRNA
  Clvs1
cctgcggaggcattt

SEQ ID NO: 75338 - DNA, 15 bp, Artificial Sequence
  dgRNA
  Clvs1
aggcatttaggaccc

SEQ ID NO: 75339 - DNA, 15 bp, Artificial Sequence
  dgRNA
  Recql
gctgatccggaaggg

SEQ ID NO: 75340 - DNA, 15 bp, Artificial Sequence
  dgRNA
  Recql
ctgatccggaagggt

SEQ ID NO: 75341 - DNA, 15 bp, Artificial Sequence
  dgRNA
  Recql
gtgggcgctgcatgc

SEQ ID NO: 75342 - DNA, 15 bp, Artificial Sequence
  dgRNA
  Recql
tgggcgctgcatgcc

SEQ ID NO: 75343 - DNA, 15 bp, Artificial Sequence
  dgRNA
  Pdrg1
cgacgttcctagagt

SEQ ID NO: 75344 - DNA, 15 bp, Artificial Sequence
  dgRNA
  Pdrg1
tcctgacacccaatc

SEQ ID NO: 75345 - DNA, 15 bp, Artificial Sequence
  dgRNA
  Pdrg1
caatctggtatgtag

SEQ ID NO: 75346 - DNA, 15 bp, Artificial Sequence
  dgRNA
  Pdrg1
atgtagtggatgccc

SEQ ID NO: 75347 - DNA, 15 bp, Artificial Sequence
  dgRNA
  Anln
tgggtgcgtgcggga

SEQ ID NO: 75348 - DNA, 15 bp, Artificial Sequence
  dgRNA
  Anln
tgcgtgcgggatggc

SEQ ID NO: 75349 - DNA, 15 bp, Artificial Sequence
  dgRNA
  Anln
gcgtgcgggatggca

SEQ ID NO: 75350 - DNA, 15 bp, Artificial Sequence
  dgRNA
  Anln
ccctaggcagttcaa

SEQ ID NO: 75351 - DNA, 15 bp, Artificial Sequence
  dgRNA
  Klk6
gatgcgggactcagc

SEQ ID NO: 75352 - DNA, 15 bp, Artificial Sequence
  dgRNA
  Klk6
atgcgggactcagca

SEQ ID NO: 75353 - DNA, 15 bp, Artificial Sequence
  dgRNA
  Klk6
tcccgcccatcttcc

SEQ ID NO: 75354 - DNA, 15 bp, Artificial Sequence
  dgRNA
  Klk6
cccgcccatcttcct

SEQ ID NO: 75355 - DNA, 15 bp, Artificial Sequence
  dgRNA
  Fam208b
tctcgcgagaagcca

SEQ ID NO: 75356 - DNA, 15 bp, Artificial Sequence
  dgRNA
  Fam208b
ctgggtcgtccaatc

SEQ ID NO: 75357 - DNA, 15 bp, Artificial Sequence
  dgRNA
  Fam208b
aaagcaggagcaacg

SEQ ID NO: 75358 - DNA, 15 bp, Artificial Sequence
  dgRNA
  Fam208b
gagcaacgtggatgc

SEQ ID NO: 75359 - DNA, 15 bp, Artificial Sequence
  dgRNA
  Sh3bp5
cggcacctctcctag

SEQ ID NO: 75360 - DNA, 15 bp, Artificial Sequence
  dgRNA
  Sh3bp5
ggactccagtgcact

SEQ ID NO: 75361 - DNA, 15 bp, Artificial Sequence
  dgRNA
  Sh3bp5
agtgtcgggtgacac

SEQ ID NO: 75362 - DNA, 15 bp, Artificial Sequence
  dgRNA
  Sh3bp5
gctatcacggcggcc

SEQ ID NO: 75363 - DNA, 15 bp, Artificial Sequence
  dgRNA
  Spink11
ctatgtctcattagt

SEQ ID NO: 75364 - DNA, 15 bp, Artificial Sequence
  dgRNA
  Sbsn
agcggcctcgctccc

SEQ ID NO: 75365 - DNA, 15 bp, Artificial Sequence
  dgRNA
  Cks1b
aatggctgcgccagc

SEQ ID NO: 75366 - DNA, 15 bp, Artificial Sequence
  dgRNA
  Cks1b
gcgccagcaggctca

SEQ ID NO: 75367 - DNA, 15 bp, Artificial Sequence
  dgRNA
  Cks1b
cgccagcaggctcaa

SEQ ID NO: 75368 - DNA, 15 bp, Artificial Sequence
  dgRNA
  Cks1b
gcagacgggtaaagg

SEQ ID NO: 75369 - DNA, 15 bp, Artificial Sequence
  dgRNA
  Stambp
tcccgttcgcataac

SEQ ID NO: 75370 - DNA, 15 bp, Artificial Sequence
  dgRNA
  Stambp
cccgttcgcataact

SEQ ID NO: 75371 - DNA, 15 bp, Artificial Sequence
  dgRNA
  Stambp
tgatgtgcaacagtc

SEQ ID NO: 75372 - DNA, 15 bp, Artificial Sequence
  dgRNA
  Stambp
agtgggatatccaga

SEQ ID NO: 75373 - DNA, 15 bp, Artificial Sequence
  dgRNA
  Kcmf1
ggctcgggtgcctgc

SEQ ID NO: 75374 - DNA, 15 bp, Artificial Sequence
  dgRNA
  Kcmf1
gtgcctgcgggaccg

SEQ ID NO: 75375 - DNA, 15 bp, Artificial Sequence
  dgRNA
  Kcmf1
ctgcgggaccgcggc

SEQ ID NO: 75376 - DNA, 15 bp, Artificial Sequence
  dgRNA
  Kcmf1
gaccgccgccaagca

SEQ ID NO: 75377 - DNA, 15 bp, Artificial Sequence
  dgRNA
  Ap1g2
ggtggatgaaaagtg

SEQ ID NO: 75378 - DNA, 15 bp, Artificial Sequence
  dgRNA
  Ap1g2
ggggagccacaatca

SEQ ID NO: 75379 - DNA, 15 bp, Artificial Sequence
  dgRNA
  Ap1g2
caagacgactcagca

SEQ ID NO: 75380 - DNA, 15 bp, Artificial Sequence
  dgRNA
  Ap1g2
gacgactcagcaggg

SEQ ID NO: 75381 - DNA, 15 bp, Artificial Sequence
  dgRNA
  Wdr83os
cagctccggtgcccg

SEQ ID NO: 75382 - DNA, 15 bp, Artificial Sequence
  dgRNA
  Wdr83os
cggtgcccgcggctt

SEQ ID NO: 75383 - DNA, 15 bp, Artificial Sequence
  dgRNA
  Wdr83os
cccgcggctttggct

SEQ ID NO: 75384 - DNA, 15 bp, Artificial Sequence
  dgRNA
  Wdr83os
cgctggactgcagcc

SEQ ID NO: 75385 - DNA, 15 bp, Artificial Sequence
  dgRNA
  Adh7
caccacttgacttgc

SEQ ID NO: 75386 - DNA, 15 bp, Artificial Sequence
  dgRNA
  Adh7
cacttgacttgcagg

SEQ ID NO: 75387 - DNA, 15 bp, Artificial Sequence
  dgRNA
  Adh7
acttgacttgcagga

SEQ ID NO: 75388 - DNA, 15 bp, Artificial Sequence
  dgRNA
  Adh7
gttgggaaaattcta

SEQ ID NO: 75389 - DNA, 15 bp, Artificial Sequence
  dgRNA
  Nanos3
atataccccctgcgc

SEQ ID NO: 75390 - DNA, 15 bp, Artificial Sequence
  dgRNA
  Nanos3
cctgcgcaggtgtat

SEQ ID NO: 75391 - DNA, 15 bp, Artificial Sequence
  dgRNA
  Nanos3
cccccagtgacaatg

SEQ ID NO: 75392 - DNA, 15 bp, Artificial Sequence
  dgRNA
  Nanos3
ccccctctaagtaaa

SEQ ID NO: 75393 - DNA, 15 bp, Artificial Sequence
  dgRNA
  Mrps7
ggtgtggactgccgc

SEQ ID NO: 75394 - DNA, 15 bp, Artificial Sequence
  dgRNA
  Mrps7
tgccgcgggccgccg

SEQ ID NO: 75395 - DNA, 15 bp, Artificial Sequence
  dgRNA
  Mrps7
cgcgggccgccgcgg

SEQ ID NO: 75396 - DNA, 15 bp, Artificial Sequence
  dgRNA
  Mrps7
cggaggggatggcgc

SEQ ID NO: 75397 - DNA, 15 bp, Artificial Sequence
  dgRNA
  BC049352
gatgcggctgttgcc

SEQ ID NO: 75398 - DNA, 15 bp, Artificial Sequence
  dgRNA
  BC049352
tgagttaggttgctg

SEQ ID NO: 75399 - DNA, 15 bp, Artificial Sequence
  dgRNA
  BC049352
gacatgggcacccct

SEQ ID NO: 75400 - DNA, 15 bp, Artificial Sequence
  dgRNA
  Cryl1
ccgtcccacgctccc

SEQ ID NO: 75401 - DNA, 15 bp, Artificial Sequence
  dgRNA
  Cryl1
tgaagtctctccccg

SEQ ID NO: 75402 - DNA, 15 bp, Artificial Sequence
  dgRNA
  Cryl1
gaagtctctccccga

SEQ ID NO: 75403 - DNA, 15 bp, Artificial Sequence
  dgRNA
  Cryl1
gcctctcctgcgcct

SEQ ID NO: 75404 - DNA, 15 bp, Artificial Sequence
  dgRNA
  Klf4
ccgcccccacgtgcg

SEQ ID NO: 75405 - DNA, 15 bp, Artificial Sequence
  dgRNA
  Klf4
catggcaacgcgcag

SEQ ID NO: 75406 - DNA, 15 bp, Artificial Sequence
  dgRNA
  Klf4
atggcaacgcgcagt

SEQ ID NO: 75407 - DNA, 15 bp, Artificial Sequence
  dgRNA
  Klf4
tggcaacgcgcagtg

SEQ ID NO: 75408 - DNA, 15 bp, Artificial Sequence
  dgRNA
  Tmx4
tcggtaaaacagcat

SEQ ID NO: 75409 - DNA, 15 bp, Artificial Sequence
  dgRNA
  Tmx4
cggtaaaacagcatt

SEQ ID NO: 75410 - DNA, 15 bp, Artificial Sequence
  dgRNA
  Tmx4
gcaggccgttgcctt

SEQ ID NO: 75411 - DNA, 15 bp, Artificial Sequence
  dgRNA
  Tmx4
tgcagacggttgctt

SEQ ID NO: 75412 - DNA, 15 bp, Artificial Sequence
  dgRNA
  Lrrc9
tctggcgcttgccct

SEQ ID NO: 75413 - DNA, 15 bp, Artificial Sequence
  dgRNA
  Lrrc9
ctggcgcttgccctt

SEQ ID NO: 75414 - DNA, 15 bp, Artificial Sequence
  dgRNA
  Lrrc9
tggcgcttgcccttg

SEQ ID NO: 75415 - DNA, 15 bp, Artificial Sequence
  dgRNA
  Lrrc9
ggcgcttgcccttgg

SEQ ID NO: 75416 - DNA, 15 bp, Artificial Sequence
  dgRNA
  Lypd5
cccaccctcttaatc

SEQ ID NO: 75417 - DNA, 15 bp, Artificial Sequence
  dgRNA
  Lypd5
ccatgattacctaga

SEQ ID NO: 75418 - DNA, 15 bp, Artificial Sequence
  dgRNA
  Lypd5
aggcattagggggcc

SEQ ID NO: 75419 - DNA, 15 bp, Artificial Sequence
  dgRNA
  Lypd5
cggattaagagggtg

SEQ ID NO: 75420 - DNA, 15 bp, Artificial Sequence
  dgRNA
  Vac14
gatccctgacaagtg

SEQ ID NO: 75421 - DNA, 15 bp, Artificial Sequence
  dgRNA
  Vac14
aagcacgagagggcg

SEQ ID NO: 75422 - DNA, 15 bp, Artificial Sequence
  dgRNA
  Vac14
ggggggcggaacctt

SEQ ID NO: 75423 - DNA, 15 bp, Artificial Sequence
  dgRNA
  Vac14
ggcggaaccttcggt

SEQ ID NO: 75424 - DNA, 15 bp, Artificial Sequence
  dgRNA
  Aloxe3
agactagactttagg

SEQ ID NO: 75425 - DNA, 15 bp, Artificial Sequence
  dgRNA
  Aloxe3
cagctttccgatgca

SEQ ID NO: 75426 - DNA, 15 bp, Artificial Sequence
  dgRNA
  Aloxe3
acggtgtgattcacg

SEQ ID NO: 75427 - DNA, 15 bp, Artificial Sequence
  dgRNA
  Aloxe3
cggtgtgattcacgt

SEQ ID NO: 75428 - DNA, 15 bp, Artificial Sequence
  dgRNA
  Tmem125
ccccacctttttcac

SEQ ID NO: 75429 - DNA, 15 bp, Artificial Sequence
  dgRNA
  Tmem125
cacgggttctactac

SEQ ID NO: 75430 - DNA, 15 bp, Artificial Sequence
  dgRNA
  Tmem125
acgggttctactacc

SEQ ID NO: 75431 - DNA, 15 bp, Artificial Sequence
  dgRNA
  Tmem125
aacctccacccacgc

SEQ ID NO: 75432 - DNA, 15 bp, Artificial Sequence
  dgRNA
  Vmn2r90
cactagtcttatgac

SEQ ID NO: 75433 - DNA, 15 bp, Artificial Sequence
  dgRNA
  Smek2
gcttcctcccggcgc

SEQ ID NO: 75434 - DNA, 15 bp, Artificial Sequence
  dgRNA
  Smek2
ggtagaaaagctcgc

SEQ ID NO: 75435 - DNA, 15 bp, Artificial Sequence
  dgRNA
  Smek2
tgagattcccgaatc

SEQ ID NO: 75436 - DNA, 15 bp, Artificial Sequence
  dgRNA
  Smek2
tcccgaatcaggaag

SEQ ID NO: 75437 - DNA, 15 bp, Artificial Sequence
  dgRNA
  Ttn
ggctgtaaggatgtt

SEQ ID NO: 75438 - DNA, 15 bp, Artificial Sequence
  dgRNA
  Ttn
gatctggggaatata

SEQ ID NO: 75439 - DNA, 15 bp, Artificial Sequence
  dgRNA
  Ttn
attcccacctcgcct

SEQ ID NO: 75440 - DNA, 15 bp, Artificial Sequence
  dgRNA
  Ttn
cctcgcctcgggtgt

SEQ ID NO: 75441 - DNA, 15 bp, Artificial Sequence
  dgRNA
  Vmn1r192
catcatcacttccac

SEQ ID NO: 75442 - DNA, 15 bp, Artificial Sequence
  dgRNA
  Vmn1r192
tgatcaaccatcctc

SEQ ID NO: 75443 - DNA, 15 bp, Artificial Sequence
  dgRNA
  Vmn1r192
tttatgcataacagt

SEQ ID NO: 75444 - DNA, 15 bp, Artificial Sequence
  dgRNA
  Urb2
tgagtgcatatactc

SEQ ID NO: 75445 - DNA, 15 bp, Artificial Sequence
  dgRNA
  Urb2
gcgccatggaggtac

SEQ ID NO: 75446 - DNA, 15 bp, Artificial Sequence
  dgRNA
  Urb2
agttaggcgccatgg

SEQ ID NO: 75447 - DNA, 15 bp, Artificial Sequence
  dgRNA
  Urb2
atgagttaggcgcca

SEQ ID NO: 75448 - DNA, 15 bp, Artificial Sequence
  dgRNA
  Opn3
ctgtatgccggaggg

SEQ ID NO: 75449 - DNA, 15 bp, Artificial Sequence
  dgRNA
  Opn3
tgtatgccggagggc

SEQ ID NO: 75450 - DNA, 15 bp, Artificial Sequence
  dgRNA
  Opn3
gtatgccggagggcg

SEQ ID NO: 75451 - DNA, 15 bp, Artificial Sequence
  dgRNA
  Opn3
agagggcggggtaac

SEQ ID NO: 75452 - DNA, 15 bp, Artificial Sequence
  dgRNA
  Col1a2
acctgccccgccgcc

SEQ ID NO: 75453 - DNA, 15 bp, Artificial Sequence
  dgRNA
  Col1a2
aagtgcttccaaact

SEQ ID NO: 75454 - DNA, 15 bp, Artificial Sequence
  dgRNA
  Col1a2
cggaggtatgcagac

SEQ ID NO: 75455 - DNA, 15 bp, Artificial Sequence
  dgRNA
  Col1a2
cgaagatgaaaaggc

SEQ ID NO: 75456 - DNA, 15 bp, Artificial Sequence
  dgRNA
  Cdh12
gcttggcataaacac

SEQ ID NO: 75457 - DNA, 15 bp, Artificial Sequence
  dgRNA
  Cdh12
acgctgcccctctgt

SEQ ID NO: 75458 - DNA, 15 bp, Artificial Sequence
  dgRNA
  Cdh12
ctcctcacccgttta

SEQ ID NO: 75459 - DNA, 15 bp, Artificial Sequence
  dgRNA
  Cdh12
ttatggttgatctga

SEQ ID NO: 75460 - DNA, 15 bp, Artificial Sequence
  dgRNA
  Rnf151
tagactactgaattg

SEQ ID NO: 75461 - DNA, 15 bp, Artificial Sequence
  dgRNA
  Rnf151
gaggccacccacctt

SEQ ID NO: 75462 - DNA, 15 bp, Artificial Sequence
  dgRNA
  Rnf151
gccacccacctttgg

SEQ ID NO: 75463 - DNA, 15 bp, Artificial Sequence
  dgRNA
  Rnf151
gtgattggcccacgc

SEQ ID NO: 75464 - DNA, 15 bp, Artificial Sequence
  dgRNA
  Arhgap12
ttgctgcttgggacc

SEQ ID NO: 75465 - DNA, 15 bp, Artificial Sequence
  dgRNA
  Arhgap12
aatgccagatgggcg

SEQ ID NO: 75466 - DNA, 15 bp, Artificial Sequence
  dgRNA
  Arhgap12
cccggaatgccagat

SEQ ID NO: 75467 - DNA, 15 bp, Artificial Sequence
  dgRNA
  Arhgap12
tcccggaatgccaga

SEQ ID NO: 75468 - DNA, 15 bp, Artificial Sequence
  dgRNA
  Matn3
aggaggcaatcggcc

SEQ ID NO: 75469 - DNA, 15 bp, Artificial Sequence
  dgRNA
  Matn3
aggcaatcggccagg

SEQ ID NO: 75470 - DNA, 15 bp, Artificial Sequence
  dgRNA
  Matn3
cgagcccaccggact

SEQ ID NO: 75471 - DNA, 15 bp, Artificial Sequence
  dgRNA
  Matn3
cccaccggactaggc

SEQ ID NO: 75472 - DNA, 15 bp, Artificial Sequence
  dgRNA
  Strn
aaactgccgcaaaga

SEQ ID NO: 75473 - DNA, 15 bp, Artificial Sequence
  dgRNA
  Strn
aactgccgcaaagat

SEQ ID NO: 75474 - DNA, 15 bp, Artificial Sequence
  dgRNA
  Strn
actgccgcaaagatg

SEQ ID NO: 75475 - DNA, 15 bp, Artificial Sequence
  dgRNA
  Strn
ctgccgcaaagatgg

SEQ ID NO: 75476 - DNA, 15 bp, Artificial Sequence
  dgRNA
  Med26
aacggccctctgtgt

SEQ ID NO: 75477 - DNA, 15 bp, Artificial Sequence
  dgRNA
  Med26
ctctgtgtcggacct

SEQ ID NO: 75478 - DNA, 15 bp, Artificial Sequence
  dgRNA
  Med26
tcggacctcggaacc

SEQ ID NO: 75479 - DNA, 15 bp, Artificial Sequence
  dgRNA
  Med26
tcggaaccaggcggc

SEQ ID NO: 75480 - DNA, 15 bp, Artificial Sequence
  dgRNA
  Apaf1
ggagacccaagctcg

SEQ ID NO: 75481 - DNA, 15 bp, Artificial Sequence
  dgRNA
  Apaf1
gagacccaagctcgc

SEQ ID NO: 75482 - DNA, 15 bp, Artificial Sequence
  dgRNA
  Apaf1
ctcgcgggtgcgcgc

SEQ ID NO: 75483 - DNA, 15 bp, Artificial Sequence
  dgRNA
  Apaf1
cccgcagactcagtc

SEQ ID NO: 75484 - DNA, 15 bp, Artificial Sequence
  dgRNA
  Otoa
cggtgtctttgaatc

SEQ ID NO: 75485 - DNA, 15 bp, Artificial Sequence
  dgRNA
  Otoa
ctaaccgcctctgcc

SEQ ID NO: 75486 - DNA, 15 bp, Artificial Sequence
  dgRNA
  Otoa
gtcattgcagcaggt

SEQ ID NO: 75487 - DNA, 15 bp, Artificial Sequence
  dgRNA
  Dctn6
gtgaacttaacgata

SEQ ID NO: 75488 - DNA, 15 bp, Artificial Sequence
  dgRNA
  Dctn6
ttaacgataaggatc

SEQ ID NO: 75489 - DNA, 15 bp, Artificial Sequence
  dgRNA
  Dctn6
taacgataaggatca

SEQ ID NO: 75490 - DNA, 15 bp, Artificial Sequence
  dgRNA
  Dctn6
gggttaggatagact

SEQ ID NO: 75491 - DNA, 15 bp, Artificial Sequence
  dgRNA
  Bmpr1b
tctccaaagtgtcgc

SEQ ID NO: 75492 - DNA, 15 bp, Artificial Sequence
  dgRNA
  Bmpr1b
aagtgtcgctggccc

SEQ ID NO: 75493 - DNA, 15 bp, Artificial Sequence
  dgRNA
  Bmpr1b
ccgcgctctgccatt

SEQ ID NO: 75494 - DNA, 15 bp, Artificial Sequence
  dgRNA
  Bmpr1b
tcgcgcttttgtttc

SEQ ID NO: 75495 - DNA, 15 bp, Artificial Sequence
  dgRNA
  Zfp101
tccaaacggaacgtc

SEQ ID NO: 75496 - DNA, 15 bp, Artificial Sequence
  dgRNA
  Zfp101
ccaaacggaacgtct

SEQ ID NO: 75497 - DNA, 15 bp, Artificial Sequence
  dgRNA
  Zfp101
gtctgggttaagatt

SEQ ID NO: 75498 - DNA, 15 bp, Artificial Sequence
  dgRNA
  Zfp101
catttgcgtcaagta

SEQ ID NO: 75499 - DNA, 15 bp, Artificial Sequence
  dgRNA
  Steap3
tagctaggtgattgt

SEQ ID NO: 75500 - DNA, 15 bp, Artificial Sequence
  dgRNA
  Steap3
agctaggtgattgta

SEQ ID NO: 75501 - DNA, 15 bp, Artificial Sequence
  dgRNA
  Steap3
tgccaccttgttaag

SEQ ID NO: 75502 - DNA, 15 bp, Artificial Sequence
  dgRNA
  Steap3
accttgttaagaggc

SEQ ID NO: 75503 - DNA, 15 bp, Artificial Sequence
  dgRNA
  Ccdc113
agacattgggcaaac

SEQ ID NO: 75504 - DNA, 15 bp, Artificial Sequence
  dgRNA
  Ccdc113
tcgatctccaccgcg

SEQ ID NO: 75505 - DNA, 15 bp, Artificial Sequence
  dgRNA
  Ccdc113
ccaccgcgaggtgca

SEQ ID NO: 75506 - DNA, 15 bp, Artificial Sequence
  dgRNA
  Ccdc113
caccgcgaggtgcaa

SEQ ID NO: 75507 - DNA, 15 bp, Artificial Sequence
  dgRNA
  Reep6
gtcccgcctcctttc

SEQ ID NO: 75508 - DNA, 15 bp, Artificial Sequence
  dgRNA
  Reep6
gcgctgatctttacc

SEQ ID NO: 75509 - DNA, 15 bp, Artificial Sequence
  dgRNA
  Reep6
tgatcacgaaggagg

SEQ ID NO: 75510 - DNA, 15 bp, Artificial Sequence
  dgRNA
  Reep6
ctgatcacgaaggag

SEQ ID NO: 75511 - DNA, 15 bp, Artificial Sequence
  dgRNA
  Pop4
taccgccgatatccc

SEQ ID NO: 75512 - DNA, 15 bp, Artificial Sequence
  dgRNA
  Pop4
ctcgcgtcctctcta

SEQ ID NO: 75513 - DNA, 15 bp, Artificial Sequence
  dgRNA
  Pop4
ggcggtaacgactgt

SEQ ID NO: 75514 - DNA, 15 bp, Artificial Sequence
  dgRNA
  Pop4
cggcggtaacgactg

SEQ ID NO: 75515 - DNA, 15 bp, Artificial Sequence
  dgRNA
  Gm7120
cggaggatcgagtcc

SEQ ID NO: 75516 - DNA, 15 bp, Artificial Sequence
  dgRNA
  Gm7120
ggaggatcgagtccc

SEQ ID NO: 75517 - DNA, 15 bp, Artificial Sequence
  dgRNA
  Gm7120
gatcgagtcccgggc

SEQ ID NO: 75518 - DNA, 15 bp, Artificial Sequence
  dgRNA
  Gm7120
atcgagtcccgggcc

SEQ ID NO: 75519 - DNA, 15 bp, Artificial Sequence
  dgRNA
  Nme2
gcagcctgagcgtcc

SEQ ID NO: 75520 - DNA, 15 bp, Artificial Sequence
  dgRNA
  Nme2
ctgagcgtcccgggt

SEQ ID NO: 75521 - DNA, 15 bp, Artificial Sequence
  dgRNA
  Nme2
tgagcgtcccgggtt

SEQ ID NO: 75522 - DNA, 15 bp, Artificial Sequence
  dgRNA
  Nme2
tcccgggttgggcag

SEQ ID NO: 75523 - DNA, 15 bp, Artificial Sequence
  dgRNA
  Chadl
aagccccagctcggc

SEQ ID NO: 75524 - DNA, 15 bp, Artificial Sequence
  dgRNA
  Chadl
agccccagctcggct

SEQ ID NO: 75525 - DNA, 15 bp, Artificial Sequence
  dgRNA
  Chadl
cattcagctcggtcc

SEQ ID NO: 75526 - DNA, 15 bp, Artificial Sequence
  dgRNA
  Chadl
gcccatgggcaaagg

SEQ ID NO: 75527 - DNA, 15 bp, Artificial Sequence
  dgRNA
  Kcng4
acagcccttactgag

SEQ ID NO: 75528 - DNA, 15 bp, Artificial Sequence
  dgRNA
  Kcng4
gaggttgcaatcgcc

SEQ ID NO: 75529 - DNA, 15 bp, Artificial Sequence
  dgRNA
  Kcng4
gcgattgcaacctca

SEQ ID NO: 75530 - DNA, 15 bp, Artificial Sequence
  dgRNA
  Kcng4
ggagccgagctcagg

SEQ ID NO: 75531 - DNA, 15 bp, Artificial Sequence
  dgRNA
  Serpine3
ccctgcagaacgtcc

SEQ ID NO: 75532 - DNA, 15 bp, Artificial Sequence
  dgRNA
  Serpine3
gaacgtccaggctcc

SEQ ID NO: 75533 - DNA, 15 bp, Artificial Sequence
  dgRNA
  Serpine3
ggaatttggacggag

SEQ ID NO: 75534 - DNA, 15 bp, Artificial Sequence
  dgRNA
  Serpine3
tggtagagacatcgc

SEQ ID NO: 75535 - DNA, 15 bp, Artificial Sequence
  dgRNA
  Frat2
tcggtgccccgtccc

SEQ ID NO: 75536 - DNA, 15 bp, Artificial Sequence
  dgRNA
  Frat2
ggcagtggtctcgca

SEQ ID NO: 75537 - DNA, 15 bp, Artificial Sequence
  dgRNA
  Frat2
gaacgtctcccccca

SEQ ID NO: 75538 - DNA, 15 bp, Artificial Sequence
  dgRNA
  Frat2
ccccacggtcgcgcg

SEQ ID NO: 75539 - DNA, 15 bp, Artificial Sequence
  dgRNA
  Dab1
gcgaacagagcgccc

SEQ ID NO: 75540 - DNA, 15 bp, Artificial Sequence
  dgRNA
  Dab1
aacagagcgccctgg

SEQ ID NO: 75541 - DNA, 15 bp, Artificial Sequence
  dgRNA
  Dab1
acagagcgccctggc

SEQ ID NO: 75542 - DNA, 15 bp, Artificial Sequence
  dgRNA
  Dab1
gcgccctggcgggag

SEQ ID NO: 75543 - DNA, 15 bp, Artificial Sequence
  dgRNA
  Khdc1c
gtaggagtgtttttt

SEQ ID NO: 75544 - DNA, 15 bp, Artificial Sequence
  dgRNA
  Khdc1c
ctacttaatgaggtc

SEQ ID NO: 75545 - DNA, 15 bp, Artificial Sequence
  dgRNA
  Ntpcr
gctttccctgccgac

SEQ ID NO: 75546 - DNA, 15 bp, Artificial Sequence
  dgRNA
  Ntpcr
tttccctgccgacag

SEQ ID NO: 75547 - DNA, 15 bp, Artificial Sequence
  dgRNA
  Ntpcr
ctgccgacaggggcg

SEQ ID NO: 75548 - DNA, 15 bp, Artificial Sequence
  dgRNA
  Ntpcr
acgcccctgtcggca

SEQ ID NO: 75549 - DNA, 15 bp, Artificial Sequence
  dgRNA
  Slc25a15
ggggctggataacgc

SEQ ID NO: 75550 - DNA, 15 bp, Artificial Sequence
  dgRNA
  Slc25a15
gggctggataacgct

SEQ ID NO: 75551 - DNA, 15 bp, Artificial Sequence
  dgRNA
  Slc25a15
cgctgggagacctca

SEQ ID NO: 75552 - DNA, 15 bp, Artificial Sequence
  dgRNA
  Slc25a15
ggtgagtcctcccgg

SEQ ID NO: 75553 - DNA, 15 bp, Artificial Sequence
  dgRNA
  F2rl2
tagggaatagaaccg

SEQ ID NO: 75554 - DNA, 15 bp, Artificial Sequence
  dgRNA
  F2rl2
atagaaccggggcag

SEQ ID NO: 75555 - DNA, 15 bp, Artificial Sequence
  dgRNA
  F2rl2
attattccaagcccc

SEQ ID NO: 75556 - DNA, 15 bp, Artificial Sequence
  dgRNA
  F2rl2
ggagaactacagcac

SEQ ID NO: 75557 - DNA, 15 bp, Artificial Sequence
  dgRNA
  Ppp1r16b
tccgggcacctcagc

SEQ ID NO: 75558 - DNA, 15 bp, Artificial Sequence
  dgRNA
  Ppp1r16b
gagagtcatcaacct

SEQ ID NO: 75559 - DNA, 15 bp, Artificial Sequence
  dgRNA
  Ppp1r16b
gagcgaaagagtgac

SEQ ID NO: 75560 - DNA, 15 bp, Artificial Sequence
  dgRNA
  Ppp1r16b
tggactccacgtcac

SEQ ID NO: 75561 - DNA, 15 bp, Artificial Sequence
  dgRNA
  Kif1c
ttaactagagtgacc

SEQ ID NO: 75562 - DNA, 15 bp, Artificial Sequence
  dgRNA
  Kif1c
taactagagtgaccc

SEQ ID NO: 75563 - DNA, 15 bp, Artificial Sequence
  dgRNA
  Kif1c
ctagagtgacccggg

SEQ ID NO: 75564 - DNA, 15 bp, Artificial Sequence
  dgRNA
  Kif1c
cgggtggctccttcc

SEQ ID NO: 75565 - DNA, 15 bp, Artificial Sequence
  dgRNA
  Car7
aaccgatacgagatg

SEQ ID NO: 75566 - DNA, 15 bp, Artificial Sequence
  dgRNA
  Car7
tacgagatgaggaat

SEQ ID NO: 75567 - DNA, 15 bp, Artificial Sequence
  dgRNA
  Car7
gacttcaccggccag

SEQ ID NO: 75568 - DNA, 15 bp, Artificial Sequence
  dgRNA
  Car7
acttcaccggccagt

SEQ ID NO: 75569 - DNA, 15 bp, Artificial Sequence
  dgRNA
  Tram1l1
agcatcagcccctta

SEQ ID NO: 75570 - DNA, 15 bp, Artificial Sequence
  dgRNA
  Abca4
cgcacttgtgtattt

SEQ ID NO: 75571 - DNA, 15 bp, Artificial Sequence
  dgRNA
  Abca4
cttacaggtaattag

SEQ ID NO: 75572 - DNA, 15 bp, Artificial Sequence
  dgRNA
  Abca4
tacaggtaattagag

SEQ ID NO: 75573 - DNA, 15 bp, Artificial Sequence
  dgRNA
  Abca4
acaggtaattagagg

SEQ ID NO: 75574 - DNA, 15 bp, Artificial Sequence
  dgRNA
  Igf2bp1
tgccgcccccaagat

SEQ ID NO: 75575 - DNA, 15 bp, Artificial Sequence
  dgRNA
  Igf2bp1
tgggttggtccgggt

SEQ ID NO: 75576 - DNA, 15 bp, Artificial Sequence
  dgRNA
  Igf2bp1
gttggtccgggttgg

SEQ ID NO: 75577 - DNA, 15 bp, Artificial Sequence
  dgRNA
  Igf2bp1
ttggtccgggttgga

SEQ ID NO: 75578 - DNA, 15 bp, Artificial Sequence
  dgRNA
  Nlrp4e
catatagtactttga

SEQ ID NO: 75579 - DNA, 15 bp, Artificial Sequence
  dgRNA
  Itih5
aaaactaggatcata

SEQ ID NO: 75580 - DNA, 15 bp, Artificial Sequence
  dgRNA
  Itih5
catagggtgagttgt

SEQ ID NO: 75581 - DNA, 15 bp, Artificial Sequence
  dgRNA
  Itih5
tggtagtgcggcgac

SEQ ID NO: 75582 - DNA, 15 bp, Artificial Sequence
  dgRNA
  Itih5
gcggcgacaggcgac

SEQ ID NO: 75583 - DNA, 15 bp, Artificial Sequence
  dgRNA
  Chm
cctctaggataaata

SEQ ID NO: 75584 - DNA, 15 bp, Artificial Sequence
  dgRNA
  Chm
ttccgctttctacct

SEQ ID NO: 75585 - DNA, 15 bp, Artificial Sequence
  dgRNA
  Chm
tccgctttctaccta

SEQ ID NO: 75586 - DNA, 15 bp, Artificial Sequence
  dgRNA
  Chm
cctagaggtttgata

SEQ ID NO: 75587 - DNA, 15 bp, Artificial Sequence
  dgRNA
  Nrg4
cttggaccgcgcttt

SEQ ID NO: 75588 - DNA, 15 bp, Artificial Sequence
  dgRNA
  Nrg4
ttggaccgcgcttta

SEQ ID NO: 75589 - DNA, 15 bp, Artificial Sequence
  dgRNA
  Nrg4
tggaccgcgctttag

SEQ ID NO: 75590 - DNA, 15 bp, Artificial Sequence
  dgRNA
  Nrg4
aatcctacccgtttg

SEQ ID NO: 75591 - DNA, 15 bp, Artificial Sequence
  dgRNA
  Peo1
tcgaagtcccgcgac

SEQ ID NO: 75592 - DNA, 15 bp, Artificial Sequence
  dgRNA
  Peo1
tcccgcgaccggtca

SEQ ID NO: 75593 - DNA, 15 bp, Artificial Sequence
  dgRNA
  Peo1
gaccggtcatggcta

SEQ ID NO: 75594 - DNA, 15 bp, Artificial Sequence
  dgRNA
  Peo1
tacggttagagagcc

SEQ ID NO: 75595 - DNA, 15 bp, Artificial Sequence
  dgRNA
  Eomes
ctgttattgctggtt

SEQ ID NO: 75596 - DNA, 15 bp, Artificial Sequence
  dgRNA
  Eomes
tttattaattggatc

SEQ ID NO: 75597 - DNA, 15 bp, Artificial Sequence
  dgRNA
  Immp1l
cagaccgggagctga

SEQ ID NO: 75598 - DNA, 15 bp, Artificial Sequence
  dgRNA
  Immp1l
ctacgatgacccaat

SEQ ID NO: 75599 - DNA, 15 bp, Artificial Sequence
  dgRNA
  Immp1l
acccaatcggaactc

SEQ ID NO: 75600 - DNA, 15 bp, Artificial Sequence
  dgRNA
  Immp1l
cccaatcggaactct

SEQ ID NO: 75601 - DNA, 15 bp, Artificial Sequence
  dgRNA
  Pcdhga8
ccgctgttcacctac

SEQ ID NO: 75602 - DNA, 15 bp, Artificial Sequence
  dgRNA
  Pcdhga8
cgctgttcacctact

SEQ ID NO: 75603 - DNA, 15 bp, Artificial Sequence
  dgRNA
  Pcdhga8
cttaggccttgcaag

SEQ ID NO: 75604 - DNA, 15 bp, Artificial Sequence
  dgRNA
  Gpr174
aagctaggtgccttc

SEQ ID NO: 75605 - DNA, 15 bp, Artificial Sequence
  dgRNA
  Slco6d1
tgacattactcacct

SEQ ID NO: 75606 - DNA, 15 bp, Artificial Sequence
  dgRNA
  Slco6d1
tactcacctcggctc

SEQ ID NO: 75607 - DNA, 15 bp, Artificial Sequence
  dgRNA
  Slco6d1
actcacctcggctca

SEQ ID NO: 75608 - DNA, 15 bp, Artificial Sequence
  dgRNA
  Slco6d1
gcaatccctgagccg

SEQ ID NO: 75609 - DNA, 15 bp, Artificial Sequence
  dgRNA
  Olfr214
ctggtgcggccgtgc

SEQ ID NO: 75610 - DNA, 15 bp, Artificial Sequence
  dgRNA
  Olfr214
ttatttggtgatagc

SEQ ID NO: 75611 - DNA, 15 bp, Artificial Sequence
  dgRNA
  Olfr214
cattactgtgaggtc

SEQ ID NO: 75612 - DNA, 15 bp, Artificial Sequence
  dgRNA
  Olfr214
ctgcacggccgcacc

SEQ ID NO: 75613 - DNA, 15 bp, Artificial Sequence
  dgRNA
  Aco1
cggctctacacttcc

SEQ ID NO: 75614 - DNA, 15 bp, Artificial Sequence
  dgRNA
  Aco1
ggctctacacttcct

SEQ ID NO: 75615 - DNA, 15 bp, Artificial Sequence
  dgRNA
  Aco1
ctagatgcagcctcg

SEQ ID NO: 75616 - DNA, 15 bp, Artificial Sequence
  dgRNA
  Aco1
agtttctcccgccta

SEQ ID NO: 75617 - DNA, 15 bp, Artificial Sequence
  dgRNA
  Sag
atggtgaagagcgaa

SEQ ID NO: 75618 - DNA, 15 bp, Artificial Sequence
  dgRNA
  Sag
gtatgttcgactgac

SEQ ID NO: 75619 - DNA, 15 bp, Artificial Sequence
  dgRNA
  Dthd1
gtaagtgttaaacaa

SEQ ID NO: 75620 - DNA, 15 bp, Artificial Sequence
  dgRNA
  Melk
cgcccagttttctcc

SEQ ID NO: 75621 - DNA, 15 bp, Artificial Sequence
  dgRNA
  Melk
gctcaggatcggtga

SEQ ID NO: 75622 - DNA, 15 bp, Artificial Sequence
  dgRNA
  Melk
ggatactaaatgtgt

SEQ ID NO: 75623 - DNA, 15 bp, Artificial Sequence
  dgRNA
  Melk
gctcaaacttttgat

SEQ ID NO: 75624 - DNA, 15 bp, Artificial Sequence
  dgRNA
  Wnt10a
gagtaggcaaaacgg

SEQ ID NO: 75625 - DNA, 15 bp, Artificial Sequence
  dgRNA
  Wnt10a
agtaggcaaaacgga

SEQ ID NO: 75626 - DNA, 15 bp, Artificial Sequence
  dgRNA
  Wnt10a
gtaggcaaaacggag

SEQ ID NO: 75627 - DNA, 15 bp, Artificial Sequence
  dgRNA
  Wnt10a
gcaaaacggaggggc

SEQ ID NO: 75628 - DNA, 15 bp, Artificial Sequence
  dgRNA
  Rraga
tgcgctagattgcaa

SEQ ID NO: 75629 - DNA, 15 bp, Artificial Sequence
  dgRNA
  Rraga
tcgcgatgtcgccac

SEQ ID NO: 75630 - DNA, 15 bp, Artificial Sequence
  dgRNA
  Rraga
tgtcgccaccggaag

SEQ ID NO: 75631 - DNA, 15 bp, Artificial Sequence
  dgRNA
  Rraga
gtcgccaccggaagt

SEQ ID NO: 75632 - DNA, 15 bp, Artificial Sequence
  dgRNA
  Sh2d2a
tatgtgttataccgc

SEQ ID NO: 75633 - DNA, 15 bp, Artificial Sequence
  dgRNA
  Olfr710
ataccaatcagcttt

SEQ ID NO: 75634 - DNA, 15 bp, Artificial Sequence
  dgRNA
  Olfr710
gctcctaaagctgat

SEQ ID NO: 75635 - DNA, 15 bp, Artificial Sequence
  dgRNA
  Ccdc103
accgcctcgcctcgg

SEQ ID NO: 75636 - DNA, 15 bp, Artificial Sequence
  dgRNA
  Ccdc103
agcttcgagaaattc

SEQ ID NO: 75637 - DNA, 15 bp, Artificial Sequence
  dgRNA
  Ccdc103
cccggagacagaaat

SEQ ID NO: 75638 - DNA, 15 bp, Artificial Sequence
  dgRNA
  Ccdc103
cctcaaaacgaagcg

SEQ ID NO: 75639 - DNA, 15 bp, Artificial Sequence
  dgRNA
  Slc7a10
tgtctcccctgacta

SEQ ID NO: 75640 - DNA, 15 bp, Artificial Sequence
  dgRNA
  Slc7a10
tcccctgactagggt

SEQ ID NO: 75641 - DNA, 15 bp, Artificial Sequence
  dgRNA
  Slc7a10
cccctgactagggtt

SEQ ID NO: 75642 - DNA, 15 bp, Artificial Sequence
  dgRNA
  Slc7a10
ccctgactagggttg

SEQ ID NO: 75643 - DNA, 15 bp, Artificial Sequence
  dgRNA
  Rnase11
gtgaatgattgtaag

SEQ ID NO: 75644 - DNA, 15 bp, Artificial Sequence
  dgRNA
  Rnase11
gctcaggttgctcaa

SEQ ID NO: 75645 - DNA, 15 bp, Artificial Sequence
  dgRNA
  Rnase11
ttcaactatatctgt

SEQ ID NO: 75646 - DNA, 15 bp, Artificial Sequence
  dgRNA
  Slc25a40
cgcgtcacgcgaccg

SEQ ID NO: 75647 - DNA, 15 bp, Artificial Sequence
  dgRNA
  Slc25a40
ccgcccttcctacgc

SEQ ID NO: 75648 - DNA, 15 bp, Artificial Sequence
  dgRNA
  Slc25a40
cgcccttcctacgcc

SEQ ID NO: 75649 - DNA, 15 bp, Artificial Sequence
  dgRNA
  Slc25a40
gcccttcctacgccg

SEQ ID NO: 75650 - DNA, 15 bp, Artificial Sequence
  dgRNA
  Wdr5
accgaacaccagtag

SEQ ID NO: 75651 - DNA, 15 bp, Artificial Sequence
  dgRNA
  Wdr5
cagtagcggtcaaat

SEQ ID NO: 75652 - DNA, 15 bp, Artificial Sequence
  dgRNA
  Wdr5
agcgagaaccacaga

SEQ ID NO: 75653 - DNA, 15 bp, Artificial Sequence
  dgRNA
  Wdr5
cagacggccccttta

SEQ ID NO: 75654 - DNA, 15 bp, Artificial Sequence
  dgRNA
  Gm5294
gaacaacccccgcac

SEQ ID NO: 75655 - DNA, 15 bp, Artificial Sequence
  dgRNA
  Gm5294
aacaacccccgcact

SEQ ID NO: 75656 - DNA, 15 bp, Artificial Sequence
  dgRNA
  Gm5294
cccccgcactgggat

SEQ ID NO: 75657 - DNA, 15 bp, Artificial Sequence
  dgRNA
  Gm5294
caggcggagcaggcg

SEQ ID NO: 75658 - DNA, 15 bp, Artificial Sequence
  dgRNA
  Pnn
gctctgcgcaagcag

SEQ ID NO: 75659 - DNA, 15 bp, Artificial Sequence
  dgRNA
  Pnn
agcggagcgcaacca

SEQ ID NO: 75660 - DNA, 15 bp, Artificial Sequence
  dgRNA
  Pnn
gagcgcaaccacggc

SEQ ID NO: 75661 - DNA, 15 bp, Artificial Sequence
  dgRNA
  Pnn
cgcaaccacggcagg

SEQ ID NO: 75662 - DNA, 15 bp, Artificial Sequence
  dgRNA
  Aanat
tggcatcatactgcc

SEQ ID NO: 75663 - DNA, 15 bp, Artificial Sequence
  dgRNA
  Aanat
ggcatcatactgcct

SEQ ID NO: 75664 - DNA, 15 bp, Artificial Sequence
  dgRNA
  Aanat
tgcctggggtaacat

SEQ ID NO: 75665 - DNA, 15 bp, Artificial Sequence
  dgRNA
  Aanat
gccgtctcaagctat

SEQ ID NO: 75666 - DNA, 15 bp, Artificial Sequence
  dgRNA
  Bcl2l12
tcccggagcgcactt

SEQ ID NO: 75667 - DNA, 15 bp, Artificial Sequence
  dgRNA
  Bcl2l12
gcacttcggcttagc

SEQ ID NO: 75668 - DNA, 15 bp, Artificial Sequence
  dgRNA
  Bcl2l12
tggccttccgcctac

SEQ ID NO: 75669 - DNA, 15 bp, Artificial Sequence
  dgRNA
  Bcl2l12
cgcctacaggcatgc

SEQ ID NO: 75670 - DNA, 15 bp, Artificial Sequence
  dgRNA
  Olfr1437
gcagcaattacactc

SEQ ID NO: 75671 - DNA, 15 bp, Artificial Sequence
  dgRNA
  Olfr1437
gcattagtggtctac

SEQ ID NO: 75672 - DNA, 15 bp, Artificial Sequence
  dgRNA
  Olfr1437
agtaagtggcattag

SEQ ID NO: 75673 - DNA, 15 bp, Artificial Sequence
  dgRNA
  Cenpt
caatcacatcagacc

SEQ ID NO: 75674 - DNA, 15 bp, Artificial Sequence
  dgRNA
  Cenpt
cggttccccagctgt

SEQ ID NO: 75675 - DNA, 15 bp, Artificial Sequence
  dgRNA
  Cenpt
ggactacagttcccg

SEQ ID NO: 75676 - DNA, 15 bp, Artificial Sequence
  dgRNA
  Cenpt
gactacagttcccgt

SEQ ID NO: 75677 - DNA, 15 bp, Artificial Sequence
  dgRNA
  Akr1b8
caccccatgcgccta

SEQ ID NO: 75678 - DNA, 15 bp, Artificial Sequence
  dgRNA
  Akr1b8
acttccggttcattg

SEQ ID NO: 75679 - DNA, 15 bp, Artificial Sequence
  dgRNA
  Akr1b8
cttccggttcattgc

SEQ ID NO: 75680 - DNA, 15 bp, Artificial Sequence
  dgRNA
  Akr1b8
ccggttcattgcggg

SEQ ID NO: 75681 - DNA, 15 bp, Artificial Sequence
  dgRNA
  Olfr1176
tatatcctgatgcct

SEQ ID NO: 75682 - DNA, 15 bp, Artificial Sequence
  dgRNA
  Rspry1
tgctccaagaccgta

SEQ ID NO: 75683 - DNA, 15 bp, Artificial Sequence
  dgRNA
  Rspry1
atggagcgatctgat

SEQ ID NO: 75684 - DNA, 15 bp, Artificial Sequence
  dgRNA
  Rspry1
tggagcgatctgatt

SEQ ID NO: 75685 - DNA, 15 bp, Artificial Sequence
  dgRNA
  Rspry1
gggtcgttcgccctt

SEQ ID NO: 75686 - DNA, 15 bp, Artificial Sequence
  dgRNA
  Eln
atagacccatagtcg

SEQ ID NO: 75687 - DNA, 15 bp, Artificial Sequence
  dgRNA
  Eln
cagattcagcctagg

SEQ ID NO: 75688 - DNA, 15 bp, Artificial Sequence
  dgRNA
  Eln
atctgcctcgactat

SEQ ID NO: 75689 - DNA, 15 bp, Artificial Sequence
  dgRNA
  Eln
aatctgcctcgacta

SEQ ID NO: 75690 - DNA, 15 bp, Artificial Sequence
  dgRNA
  Rbm46
tttggcagaccttaa

SEQ ID NO: 75691 - DNA, 15 bp, Artificial Sequence
  dgRNA
  Rbm46
ctaatcataccttta

SEQ ID NO: 75692 - DNA, 15 bp, Artificial Sequence
  dgRNA
  Rbm46
cagctctcggagtct

SEQ ID NO: 75693 - DNA, 15 bp, Artificial Sequence
  dgRNA
  Rbm46
acagctctcggagtc

SEQ ID NO: 75694 - DNA, 15 bp, Artificial Sequence
  dgRNA
  Ltb4r2
ggagcagtcgttagc

SEQ ID NO: 75695 - DNA, 15 bp, Artificial Sequence
  dgRNA
  Ltb4r2
actgctcttctccgc

SEQ ID NO: 75696 - DNA, 15 bp, Artificial Sequence
  dgRNA
  Ltb4r2
gatggtgctcaccct

SEQ ID NO: 75697 - DNA, 15 bp, Artificial Sequence
  dgRNA
  Kifc2
aggtctttgcgaaag

SEQ ID NO: 75698 - DNA, 15 bp, Artificial Sequence
  dgRNA
  Kifc2
ggtctttgcgaaaga

SEQ ID NO: 75699 - DNA, 15 bp, Artificial Sequence
  dgRNA
  Kifc2
taaaaaccgcttgat

SEQ ID NO: 75700 - DNA, 15 bp, Artificial Sequence
  dgRNA
  Kifc2
aaaaaccgcttgata

SEQ ID NO: 75701 - DNA, 15 bp, Artificial Sequence
  dgRNA
  Ext2
agagcttggtgcgcc

SEQ ID NO: 75702 - DNA, 15 bp, Artificial Sequence
  dgRNA
  Ext2
tgcctttgccccgaa

SEQ ID NO: 75703 - DNA, 15 bp, Artificial Sequence
  dgRNA
  Ext2
gcctttgccccgaac

SEQ ID NO: 75704 - DNA, 15 bp, Artificial Sequence
  dgRNA
  Ext2
tcactcactagttcc

SEQ ID NO: 75705 - DNA, 15 bp, Artificial Sequence
  dgRNA
  Olfr481
catacattaactaca

SEQ ID NO: 75706 - DNA, 15 bp, Artificial Sequence
  dgRNA
  Olfr481
ctcaatggtgcctac

SEQ ID NO: 75707 - DNA, 15 bp, Artificial Sequence
  dgRNA
  1810041L15Rik
aactaggggtgtgat

SEQ ID NO: 75708 - DNA, 15 bp, Artificial Sequence
  dgRNA
  1810041L15Rik
aaacccaggtctagc

SEQ ID NO: 75709 - DNA, 15 bp, Artificial Sequence
  dgRNA
  1810041L15Rik
ttcacccccatttca

SEQ ID NO: 75710 - DNA, 15 bp, Artificial Sequence
  dgRNA
  Zfpm1
agacgagcgctagtt

SEQ ID NO: 75711 - DNA, 15 bp, Artificial Sequence
  dgRNA
  Zfpm1
gacgagcgctagttt

SEQ ID NO: 75712 - DNA, 15 bp, Artificial Sequence
  dgRNA
  Zfpm1
acgagcgctagtttg

SEQ ID NO: 75713 - DNA, 15 bp, Artificial Sequence
  dgRNA
  Zfpm1
agcgctagtttgggg

SEQ ID NO: 75714 - DNA, 15 bp, Artificial Sequence
  dgRNA
  Defb8
tgtagaatcctatcc

SEQ ID NO: 75715 - DNA, 15 bp, Artificial Sequence
  dgRNA
  Nfix
ctgtgcaatggagcg

SEQ ID NO: 75716 - DNA, 15 bp, Artificial Sequence
  dgRNA
  Nfix
tgtgcaatggagcgt

SEQ ID NO: 75717 - DNA, 15 bp, Artificial Sequence
  dgRNA
  Nfix
gtgcaatggagcgtg

SEQ ID NO: 75718 - DNA, 15 bp, Artificial Sequence
  dgRNA
  Nfix
tgcaatggagcgtgg

SEQ ID NO: 75719 - DNA, 15 bp, Artificial Sequence
  dgRNA
  Mettl22
aacaccgaagtgcag

SEQ ID NO: 75720 - DNA, 15 bp, Artificial Sequence
  dgRNA
  Mettl22
gaggcgtccccactc

SEQ ID NO: 75721 - DNA, 15 bp, Artificial Sequence
  dgRNA
  Mettl22
cgtccccactctgga

SEQ ID NO: 75722 - DNA, 15 bp, Artificial Sequence
  dgRNA
  Mettl22
atgagcaatccgacc

SEQ ID NO: 75723 - DNA, 15 bp, Artificial Sequence
  dgRNA
  Orm1
actctggtgtacggc

SEQ ID NO: 75724 - DNA, 15 bp, Artificial Sequence
  dgRNA
  Orm1
tgtgtcaggaccagt

SEQ ID NO: 75725 - DNA, 15 bp, Artificial Sequence
  dgRNA
  Orm1
aggaccagtaggttg

SEQ ID NO: 75726 - DNA, 15 bp, Artificial Sequence
  dgRNA
  Orm1
ggaccagtaggttga

SEQ ID NO: 75727 - DNA, 15 bp, Artificial Sequence
  dgRNA
  Rbm44
catttaagccccacc

SEQ ID NO: 75728 - DNA, 15 bp, Artificial Sequence
  dgRNA
  Rbm44
ccaccaggccaatca

SEQ ID NO: 75729 - DNA, 15 bp, Artificial Sequence
  dgRNA
  Rbm44
ggagctctcctcgag

SEQ ID NO: 75730 - DNA, 15 bp, Artificial Sequence
  dgRNA
  Rbm44
gctctcctcgagcgg

SEQ ID NO: 75731 - DNA, 15 bp, Artificial Sequence
  dgRNA
  Epb41l5
gagcgtcccgccctt

SEQ ID NO: 75732 - DNA, 15 bp, Artificial Sequence
  dgRNA
  Epb41l5
agcgtcccgcccttc

SEQ ID NO: 75733 - DNA, 15 bp, Artificial Sequence
  dgRNA
  Epb41l5
gcgtcccgcccttcg

SEQ ID NO: 75734 - DNA, 15 bp, Artificial Sequence
  dgRNA
  Epb41l5
cgtcccgcccttcgg

SEQ ID NO: 75735 - DNA, 15 bp, Artificial Sequence
  dgRNA
  Alkbh2
atgctgtagcacact

SEQ ID NO: 75736 - DNA, 15 bp, Artificial Sequence
  dgRNA
  Alkbh2
cgtagaccccagaac

SEQ ID NO: 75737 - DNA, 15 bp, Artificial Sequence
  dgRNA
  Alkbh2
ccagaactggtccac

SEQ ID NO: 75738 - DNA, 15 bp, Artificial Sequence
  dgRNA
  Alkbh2
catcctgcggtgcgc

SEQ ID NO: 75739 - DNA, 15 bp, Artificial Sequence
  dgRNA
  Cdc42bpb
aacagagccgaacta

SEQ ID NO: 75740 - DNA, 15 bp, Artificial Sequence
  dgRNA
  Cdc42bpb
acagagccgaactat

SEQ ID NO: 75741 - DNA, 15 bp, Artificial Sequence
  dgRNA
  Cdc42bpb
cgaactatgggaccc

SEQ ID NO: 75742 - DNA, 15 bp, Artificial Sequence
  dgRNA
  Cdc42bpb
agggcgcacacagcg

SEQ ID NO: 75743 - DNA, 15 bp, Artificial Sequence
  dgRNA
  Kptn
ccccatctcaaatcc

SEQ ID NO: 75744 - DNA, 15 bp, Artificial Sequence
  dgRNA
  Kptn
tccatagctccgaaa

SEQ ID NO: 75745 - DNA, 15 bp, Artificial Sequence
  dgRNA
  Kptn
ccatagctccgaaat

SEQ ID NO: 75746 - DNA, 15 bp, Artificial Sequence
  dgRNA
  Kptn
aagggcaattttgtc

SEQ ID NO: 75747 - DNA, 15 bp, Artificial Sequence
  dgRNA
  Mmgt1
tccggcgcgtatttg

SEQ ID NO: 75748 - DNA, 15 bp, Artificial Sequence
  dgRNA
  Mmgt1
acctcgtctccccat

SEQ ID NO: 75749 - DNA, 15 bp, Artificial Sequence
  dgRNA
  Mmgt1
cccattggtctcgct

SEQ ID NO: 75750 - DNA, 15 bp, Artificial Sequence
  dgRNA
  Mmgt1
actgcgcagtcgcag

SEQ ID NO: 75751 - DNA, 15 bp, Artificial Sequence
  dgRNA
  Tinf2
tttcctgggagcggc

SEQ ID NO: 75752 - DNA, 15 bp, Artificial Sequence
  dgRNA
  Tinf2
gagcggctggcggcc

SEQ ID NO: 75753 - DNA, 15 bp, Artificial Sequence
  dgRNA
  Tinf2
agcggctggcggccc

SEQ ID NO: 75754 - DNA, 15 bp, Artificial Sequence
  dgRNA
  Tinf2
gctggcggcccggga

SEQ ID NO: 75755 - DNA, 15 bp, Artificial Sequence
  dgRNA
  Olfr1356
ttagcattatttggc

SEQ ID NO: 75756 - DNA, 15 bp, Artificial Sequence
  dgRNA
  Olfr1356
attagctagacattg

SEQ ID NO: 75757 - DNA, 15 bp, Artificial Sequence
  dgRNA
  Olfr1356
cagggattacccaaa

SEQ ID NO: 75758 - DNA, 15 bp, Artificial Sequence
  dgRNA
  Dnttip1
cgtcccttgactgaa

SEQ ID NO: 75759 - DNA, 15 bp, Artificial Sequence
  dgRNA
  Dnttip1
cagccgttgtctccc

SEQ ID NO: 75760 - DNA, 15 bp, Artificial Sequence
  dgRNA
  Dnttip1
agccgttgtctccca

SEQ ID NO: 75761 - DNA, 15 bp, Artificial Sequence
  dgRNA
  Dnttip1
gccgttgtctcccag

SEQ ID NO: 75762 - DNA, 15 bp, Artificial Sequence
  dgRNA
  Iqcg
tttcgtctttgtaag

SEQ ID NO: 75763 - DNA, 15 bp, Artificial Sequence
  dgRNA
  Iqcg
caacacgtattattt

SEQ ID NO: 75764 - DNA, 15 bp, Artificial Sequence
  dgRNA
  Iqcg
ttcttgagcgcggct

SEQ ID NO: 75765 - DNA, 15 bp, Artificial Sequence
  dgRNA
  Iqcg
taaagttcttgagcg

SEQ ID NO: 75766 - DNA, 15 bp, Artificial Sequence
  dgRNA
  Etl4
tggaacgggatatac

SEQ ID NO: 75767 - DNA, 15 bp, Artificial Sequence
  dgRNA
  Etl4
aaaagtgctggtatg

SEQ ID NO: 75768 - DNA, 15 bp, Artificial Sequence
  dgRNA
  Hmga2
ccgcctaacatttca

SEQ ID NO: 75769 - DNA, 15 bp, Artificial Sequence
  dgRNA
  Hmga2
cgcctaacatttcaa

SEQ ID NO: 75770 - DNA, 15 bp, Artificial Sequence
  dgRNA
  Hmga2
ttgaaatgttaggcg

SEQ ID NO: 75771 - DNA, 15 bp, Artificial Sequence
  dgRNA
  Hmga2
cttgaaatgttaggc

SEQ ID NO: 75772 - DNA, 15 bp, Artificial Sequence
  dgRNA
  Chd1l
caagcaacccaagtt

SEQ ID NO: 75773 - DNA, 15 bp, Artificial Sequence
  dgRNA
  Chd1l
cgtgctaaggaagcg

SEQ ID NO: 75774 - DNA, 15 bp, Artificial Sequence
  dgRNA
  Chd1l
gtgctaaggaagcgt

SEQ ID NO: 75775 - DNA, 15 bp, Artificial Sequence
  dgRNA
  Chd1l
gcgagctgcgccctc

SEQ ID NO: 75776 - DNA, 15 bp, Artificial Sequence
  dgRNA
  Ppp5c
ctacaagtacaagta

SEQ ID NO: 75777 - DNA, 15 bp, Artificial Sequence
  dgRNA
  Ppp5c
agtacaagtacggtc

SEQ ID NO: 75778 - DNA, 15 bp, Artificial Sequence
  dgRNA
  Ppp5c
ggtctggataccctc

SEQ ID NO: 75779 - DNA, 15 bp, Artificial Sequence
  dgRNA
  Ppp5c
gtcctcccggcgctc

SEQ ID NO: 75780 - DNA, 15 bp, Artificial Sequence
  dgRNA
  Nudcd2
ctaccgccgcccaat

SEQ ID NO: 75781 - DNA, 15 bp, Artificial Sequence
  dgRNA
  Nudcd2
cgccgcccaatcgga

SEQ ID NO: 75782 - DNA, 15 bp, Artificial Sequence
  dgRNA
  Nudcd2
ctagtagccaataag

SEQ ID NO: 75783 - DNA, 15 bp, Artificial Sequence
  dgRNA
  Nudcd2
ctatccaatcacttc

SEQ ID NO: 75784 - DNA, 15 bp, Artificial Sequence
  dgRNA
  Keap1
ataaatatcgcaacc

SEQ ID NO: 75785 - DNA, 15 bp, Artificial Sequence
  dgRNA
  Keap1
tcgcaaccaggtaga

SEQ ID NO: 75786 - DNA, 15 bp, Artificial Sequence
  dgRNA
  Keap1
cgcaaccaggtagat

SEQ ID NO: 75787 - DNA, 15 bp, Artificial Sequence
  dgRNA
  Keap1
gtagatgggtctagt

SEQ ID NO: 75788 - DNA, 15 bp, Artificial Sequence
  dgRNA
  Rap2a
gcgcggacggtcgct

SEQ ID NO: 75789 - DNA, 15 bp, Artificial Sequence
  dgRNA
  Rap2a
acggtcgctaggcga

SEQ ID NO: 75790 - DNA, 15 bp, Artificial Sequence
  dgRNA
  Rap2a
ctaggcgacggcgcg

SEQ ID NO: 75791 - DNA, 15 bp, Artificial Sequence
  dgRNA
  Rap2a
taggcgacggcgcga

SEQ ID NO: 75792 - DNA, 15 bp, Artificial Sequence
  dgRNA
  Nlgn3
attgggccatgcccc

SEQ ID NO: 75793 - DNA, 15 bp, Artificial Sequence
  dgRNA
  Nlgn3
gacttgagccatcac

SEQ ID NO: 75794 - DNA, 15 bp, Artificial Sequence
  dgRNA
  Nlgn3
catcactggcacaaa

SEQ ID NO: 75795 - DNA, 15 bp, Artificial Sequence
  dgRNA
  Nlgn3
aaaggagttaatgcc

SEQ ID NO: 75796 - DNA, 15 bp, Artificial Sequence
  dgRNA
  Sh2d4b
cccctcttatctgca

SEQ ID NO: 75797 - DNA, 15 bp, Artificial Sequence
  dgRNA
  Sh2d4b
tcttatctgcagggg

SEQ ID NO: 75798 - DNA, 15 bp, Artificial Sequence
  dgRNA
  Sh2d4b
gacacctcccgaccc

SEQ ID NO: 75799 - DNA, 15 bp, Artificial Sequence
  dgRNA
  Sh2d4b
cgacccaggtggatt

SEQ ID NO: 75800 - DNA, 15 bp, Artificial Sequence
  dgRNA
  Olfr691
tagaggctagtggct

SEQ ID NO: 75801 - DNA, 15 bp, Artificial Sequence
  dgRNA
  Olfr691
tcacctagaggctag

SEQ ID NO: 75802 - DNA, 15 bp, Artificial Sequence
  dgRNA
  Serpina11
acactatcaccctgt

SEQ ID NO: 75803 - DNA, 15 bp, Artificial Sequence
  dgRNA
  Serpina11
tatcaccctgtgggc

SEQ ID NO: 75804 - DNA, 15 bp, Artificial Sequence
  dgRNA
  Serpina11
acagggtgatagtgt

SEQ ID NO: 75805 - DNA, 15 bp, Artificial Sequence
  dgRNA
  Rai2
aggctaccacttgtg

SEQ ID NO: 75806 - DNA, 15 bp, Artificial Sequence
  dgRNA
  Rai2
ttgtgcggctcgccc

SEQ ID NO: 75807 - DNA, 15 bp, Artificial Sequence
  dgRNA
  Rai2
cggctcgcccaggcc

SEQ ID NO: 75808 - DNA, 15 bp, Artificial Sequence
  dgRNA
  Rai2
aggccaggctcccgc

SEQ ID NO: 75809 - DNA, 15 bp, Artificial Sequence
  dgRNA
  Olfr688
aatggagatcatctt

SEQ ID NO: 75810 - DNA, 15 bp, Artificial Sequence
  dgRNA
  Olfr688
aacgtcctagatgac

SEQ ID NO: 75811 - DNA, 15 bp, Artificial Sequence
  dgRNA
  Olfr688
gcgatggggagctag

SEQ ID NO: 75812 - DNA, 15 bp, Artificial Sequence
  dgRNA
  Olfr688
tgcctgtagattgaa

SEQ ID NO: 75813 - DNA, 15 bp, Artificial Sequence
  dgRNA
  Dnase2b
ggttatcaactagac

SEQ ID NO: 75814 - DNA, 15 bp, Artificial Sequence
  dgRNA
  Dnase2b
gacacaccctaatta

SEQ ID NO: 75815 - DNA, 15 bp, Artificial Sequence
  dgRNA
  Dnase2b
gaagataaagcgata

SEQ ID NO: 75816 - DNA, 15 bp, Artificial Sequence
  dgRNA
  Dnase2b
cagtcatcatgtggc

SEQ ID NO: 75817 - DNA, 15 bp, Artificial Sequence
  dgRNA
  Plekhb1
tataaccgggatggg

SEQ ID NO: 75818 - DNA, 15 bp, Artificial Sequence
  dgRNA
  Plekhb1
ttctataaccgggat

SEQ ID NO: 75819 - DNA, 15 bp, Artificial Sequence
  dgRNA
  Plekhb1
tttctataaccggga

SEQ ID NO: 75820 - DNA, 15 bp, Artificial Sequence
  dgRNA
  Cnot6l
tggcgcgctgaatgc

SEQ ID NO: 75821 - DNA, 15 bp, Artificial Sequence
  dgRNA
  Cnot6l
cgctgaatgcaggtg

SEQ ID NO: 75822 - DNA, 15 bp, Artificial Sequence
  dgRNA
  Cnot6l
gcgggcctcgactcc

SEQ ID NO: 75823 - DNA, 15 bp, Artificial Sequence
  dgRNA
  Cnot6l
tgcgcgctcgccttc

SEQ ID NO: 75824 - DNA, 15 bp, Artificial Sequence
  dgRNA
  Naglu
ggctagatatttgga

SEQ ID NO: 75825 - DNA, 15 bp, Artificial Sequence
  dgRNA
  Naglu
agggccgaatctgaa

SEQ ID NO: 75826 - DNA, 15 bp, Artificial Sequence
  dgRNA
  Naglu
gggccgaatctgaaa

SEQ ID NO: 75827 - DNA, 15 bp, Artificial Sequence
  dgRNA
  Naglu
tgcgcagcgtctcat

SEQ ID NO: 75828 - DNA, 15 bp, Artificial Sequence
  dgRNA
  Homez
gtgcttaagagtgcc

SEQ ID NO: 75829 - DNA, 15 bp, Artificial Sequence
  dgRNA
  Nab2
cagccagcgcagcgc

SEQ ID NO: 75830 - DNA, 15 bp, Artificial Sequence
  dgRNA
  Nab2
agccagcgcagcgcc

SEQ ID NO: 75831 - DNA, 15 bp, Artificial Sequence
  dgRNA
  Nab2
cctgtgcgtcctgcg

SEQ ID NO: 75832 - DNA, 15 bp, Artificial Sequence
  dgRNA
  Nab2
ctgtgcgtcctgcgg

SEQ ID NO: 75833 - DNA, 15 bp, Artificial Sequence
  dgRNA
  Olfr823
cttagagctaatgca

SEQ ID NO: 75834 - DNA, 15 bp, Artificial Sequence
  dgRNA
  Olfr823
agtcctcccctgaat

SEQ ID NO: 75835 - DNA, 15 bp, Artificial Sequence
  dgRNA
  Olfr823
gctcctattcagggg

SEQ ID NO: 75836 - DNA, 15 bp, Artificial Sequence
  dgRNA
  Olfr823
atggctcctattcag

SEQ ID NO: 75837 - DNA, 15 bp, Artificial Sequence
  dgRNA
  Nlrp4f
ttgtatcctctgccg

SEQ ID NO: 75838 - DNA, 15 bp, Artificial Sequence
  dgRNA
  Nlrp4f
ggtgggtcgaaaaaa

SEQ ID NO: 75839 - DNA, 15 bp, Artificial Sequence
  dgRNA
  Nlrp4f
tggtgggtcgaaaaa

SEQ ID NO: 75840 - DNA, 15 bp, Artificial Sequence
  dgRNA
  Nlrp4f
caaactggttctggt

SEQ ID NO: 75841 - DNA, 15 bp, Artificial Sequence
  dgRNA
  Ppfia1
ttaccggtgtttcca

SEQ ID NO: 75842 - DNA, 15 bp, Artificial Sequence
  dgRNA
  Ppfia1
tcgccctgtctccgc

SEQ ID NO: 75843 - DNA, 15 bp, Artificial Sequence
  dgRNA
  Ppfia1
cgccctgtctccgca

SEQ ID NO: 75844 - DNA, 15 bp, Artificial Sequence
  dgRNA
  Ppfia1
gccctgtctccgcag

SEQ ID NO: 75845 - DNA, 15 bp, Artificial Sequence
  dgRNA
  Plac8l1
ggacagaccctcagt

SEQ ID NO: 75846 - DNA, 15 bp, Artificial Sequence
  dgRNA
  Plac8l1
cacatgcccaactga

SEQ ID NO: 75847 - DNA, 15 bp, Artificial Sequence
  dgRNA
  Plac8l1
gcacatgcccaactg

SEQ ID NO: 75848 - DNA, 15 bp, Artificial Sequence
  dgRNA
  Plac8l1
gttaccttggtgttc

SEQ ID NO: 75849 - DNA, 15 bp, Artificial Sequence
  dgRNA
  Itm2b
ccgctgagtcctggg

SEQ ID NO: 75850 - DNA, 15 bp, Artificial Sequence
  dgRNA
  Itm2b
gtctggcgtgaagcc

SEQ ID NO: 75851 - DNA, 15 bp, Artificial Sequence
  dgRNA
  Itm2b
cgcgccccagctgcg

SEQ ID NO: 75852 - DNA, 15 bp, Artificial Sequence
  dgRNA
  Itm2b
acttgttgcccctct

SEQ ID NO: 75853 - DNA, 15 bp, Artificial Sequence
  dgRNA
  Olfr20
agtcactactgctac

SEQ ID NO: 75854 - DNA, 15 bp, Artificial Sequence
  dgRNA
  Olfr20
ttaatgagttcctcg

SEQ ID NO: 75855 - DNA, 15 bp, Artificial Sequence
  dgRNA
  Olfr20
gatacagagcccctt

SEQ ID NO: 75856 - DNA, 15 bp, Artificial Sequence
  dgRNA
  Olfr20
tactttgggggccat

SEQ ID NO: 75857 - DNA, 15 bp, Artificial Sequence
  dgRNA
  Glb1l3
attcccagtgccgag

SEQ ID NO: 75858 - DNA, 15 bp, Artificial Sequence
  dgRNA
  Glb1l3
tgccgagaggcattt

SEQ ID NO: 75859 - DNA, 15 bp, Artificial Sequence
  dgRNA
  Glb1l3
gccgagaggcatttg

SEQ ID NO: 75860 - DNA, 15 bp, Artificial Sequence
  dgRNA
  Glb1l3
taaactgcagccagc

SEQ ID NO: 75861 - DNA, 15 bp, Artificial Sequence
  dgRNA
  Pnkd
aggagtagttctccg

SEQ ID NO: 75862 - DNA, 15 bp, Artificial Sequence
  dgRNA
  Pnkd
ccggggcccgctacg

SEQ ID NO: 75863 - DNA, 15 bp, Artificial Sequence
  dgRNA
  Pnkd
cgctacgcggacttc

SEQ ID NO: 75864 - DNA, 15 bp, Artificial Sequence
  dgRNA
  Pnkd
gctacgcggacttct

SEQ ID NO: 75865 - DNA, 15 bp, Artificial Sequence
  dgRNA
  Pdk2
gcaccttcacggtta

SEQ ID NO: 75866 - DNA, 15 bp, Artificial Sequence
  dgRNA
  Pdk2
ccttcacggttaagg

SEQ ID NO: 75867 - DNA, 15 bp, Artificial Sequence
  dgRNA
  Pdk2
tcacggttaaggagg

SEQ ID NO: 75868 - DNA, 15 bp, Artificial Sequence
  dgRNA
  Pdk2
cacggttaaggaggt

SEQ ID NO: 75869 - DNA, 15 bp, Artificial Sequence
  dgRNA
  Serpine2
gccgcacctcgagcc

SEQ ID NO: 75870 - DNA, 15 bp, Artificial Sequence
  dgRNA
  Serpine2
cgagcccggcgcgtc

SEQ ID NO: 75871 - DNA, 15 bp, Artificial Sequence
  dgRNA
  Serpine2
cccggcgcgtctggc

SEQ ID NO: 75872 - DNA, 15 bp, Artificial Sequence
  dgRNA
  Serpine2
ctggccggagctttc

SEQ ID NO: 75873 - DNA, 15 bp, Artificial Sequence
  dgRNA
  Mief1
tcggaggaggggccg

SEQ ID NO: 75874 - DNA, 15 bp, Artificial Sequence
  dgRNA
  Mief1
taggtaacgtcacct

SEQ ID NO: 75875 - DNA, 15 bp, Artificial Sequence
  dgRNA
  Mief1
gtaacgtcacctagg

SEQ ID NO: 75876 - DNA, 15 bp, Artificial Sequence
  dgRNA
  Mief1
acgtcacctaggagg

SEQ ID NO: 75877 - DNA, 15 bp, Artificial Sequence
  dgRNA
  BC037034
gtctagcatccttaa

SEQ ID NO: 75878 - DNA, 15 bp, Artificial Sequence
  dgRNA
  BC037034
gccaagaagcctcgg

SEQ ID NO: 75879 - DNA, 15 bp, Artificial Sequence
  dgRNA
  BC037034
cagcgcccgcactcc

SEQ ID NO: 75880 - DNA, 15 bp, Artificial Sequence
  dgRNA
  BC037034
cccgcactcctggtc

SEQ ID NO: 75881 - DNA, 15 bp, Artificial Sequence
  dgRNA
  Olfr167
tgattattctcagtc

SEQ ID NO: 75882 - DNA, 15 bp, Artificial Sequence
  dgRNA
  Olfr167
tctcatacataagtt

SEQ ID NO: 75883 - DNA, 15 bp, Artificial Sequence
  dgRNA
  Olfr167
gtctcatacataagt

SEQ ID NO: 75884 - DNA, 15 bp, Artificial Sequence
  dgRNA
  Lca5l
attccttcagccgcc

SEQ ID NO: 75885 - DNA, 15 bp, Artificial Sequence
  dgRNA
  Lca5l
ttccttcagccgcct

SEQ ID NO: 75886 - DNA, 15 bp, Artificial Sequence
  dgRNA
  Lca5l
cgatctagacctccc

SEQ ID NO: 75887 - DNA, 15 bp, Artificial Sequence
  dgRNA
  Lca5l
acgcatgcgcgcaac

SEQ ID NO: 75888 - DNA, 15 bp, Artificial Sequence
  dgRNA
  Katnb1
gtgattagtctgagt

SEQ ID NO: 75889 - DNA, 15 bp, Artificial Sequence
  dgRNA
  Katnb1
gattagtctgagtcg

SEQ ID NO: 75890 - DNA, 15 bp, Artificial Sequence
  dgRNA
  Katnb1
gtctgagtcggggaa

SEQ ID NO: 75891 - DNA, 15 bp, Artificial Sequence
  dgRNA
  Katnb1
ggtagttacgtaaat

SEQ ID NO: 75892 - DNA, 15 bp, Artificial Sequence
  dgRNA
  Farp1
gcgcacctgcctccg

SEQ ID NO: 75893 - DNA, 15 bp, Artificial Sequence
  dgRNA
  Farp1
acctgcctccggggc

SEQ ID NO: 75894 - DNA, 15 bp, Artificial Sequence
  dgRNA
  Farp1
ggcggggccgctgtg

SEQ ID NO: 75895 - DNA, 15 bp, Artificial Sequence
  dgRNA
  Farp1
gcggggccgctgtgc

SEQ ID NO: 75896 - DNA, 15 bp, Artificial Sequence
  dgRNA
  Mterf4
tcggcggacacagat

SEQ ID NO: 75897 - DNA, 15 bp, Artificial Sequence
  dgRNA
  Mterf4
gcggacacagatcgg

SEQ ID NO: 75898 - DNA, 15 bp, Artificial Sequence
  dgRNA
  Mterf4
acacagatcggaggc

SEQ ID NO: 75899 - DNA, 15 bp, Artificial Sequence
  dgRNA
  Mterf4
cggacgttgtgagcc

SEQ ID NO: 75900 - DNA, 15 bp, Artificial Sequence
  dgRNA
  Sema4g
agagtacaagactcc

SEQ ID NO: 75901 - DNA, 15 bp, Artificial Sequence
  dgRNA
  Sema4g
caagactccgggacc

SEQ ID NO: 75902 - DNA, 15 bp, Artificial Sequence
  dgRNA
  Sema4g
aagactccgggaccc

SEQ ID NO: 75903 - DNA, 15 bp, Artificial Sequence
  dgRNA
  Sema4g
agactccgggacccg

SEQ ID NO: 75904 - DNA, 15 bp, Artificial Sequence
  dgRNA
  Lifr
tgggaagcccgatgt

SEQ ID NO: 75905 - DNA, 15 bp, Artificial Sequence
  dgRNA
  Lifr
ttggactgttgaccg

SEQ ID NO: 75906 - DNA, 15 bp, Artificial Sequence
  dgRNA
  Lifr
atctctgcgcagctt

SEQ ID NO: 75907 - DNA, 15 bp, Artificial Sequence
  dgRNA
  Lifr
tggtgttgcgcacct

SEQ ID NO: 75908 - DNA, 15 bp, Artificial Sequence
  dgRNA
  Olfr986
gatgattctagtcaa

SEQ ID NO: 75909 - DNA, 15 bp, Artificial Sequence
  dgRNA
  Olfr986
cgatgattctagtca

SEQ ID NO: 75910 - DNA, 15 bp, Artificial Sequence
  dgRNA
  Lhx2
acgcagggagggatc

SEQ ID NO: 75911 - DNA, 15 bp, Artificial Sequence
  dgRNA
  Lhx2
cgcagggagggatcc

SEQ ID NO: 75912 - DNA, 15 bp, Artificial Sequence
  dgRNA
  Lhx2
aagatcgacagacac

SEQ ID NO: 75913 - DNA, 15 bp, Artificial Sequence
  dgRNA
  Lhx2
agatcgacagacacc

SEQ ID NO: 75914 - DNA, 15 bp, Artificial Sequence
  dgRNA
  Il20
actgcggaactgtga

SEQ ID NO: 75915 - DNA, 15 bp, Artificial Sequence
  dgRNA
  Rpgrip1l
ctcccgagtactcct

SEQ ID NO: 75916 - DNA, 15 bp, Artificial Sequence
  dgRNA
  Rpgrip1l
tcccgagtactcctt

SEQ ID NO: 75917 - DNA, 15 bp, Artificial Sequence
  dgRNA
  Rpgrip1l
ctccagtcagctagc

SEQ ID NO: 75918 - DNA, 15 bp, Artificial Sequence
  dgRNA
  Rpgrip1l
tacgcgacccgccga

SEQ ID NO: 75919 - DNA, 15 bp, Artificial Sequence
  dgRNA
  Cldn18
agaacgcactatcta

SEQ ID NO: 75920 - DNA, 15 bp, Artificial Sequence
  dgRNA
  Cldn18
cagaacgcactatct

SEQ ID NO: 75921 - DNA, 15 bp, Artificial Sequence
  dgRNA
  Sertad4
actgcaactcacggc

SEQ ID NO: 75922 - DNA, 15 bp, Artificial Sequence
  dgRNA
  Sertad4
ctcacggctggaaac

SEQ ID NO: 75923 - DNA, 15 bp, Artificial Sequence
  dgRNA
  Sertad4
tcgcagtgttttgac

SEQ ID NO: 75924 - DNA, 15 bp, Artificial Sequence
  dgRNA
  Sertad4
agccagatgcatggc

SEQ ID NO: 75925 - DNA, 15 bp, Artificial Sequence
  dgRNA
  Csmd2
aagcttcaatataac

SEQ ID NO: 75926 - DNA, 15 bp, Artificial Sequence
  dgRNA
  Csmd2
acacaatgcaccaca

SEQ ID NO: 75927 - DNA, 15 bp, Artificial Sequence
  dgRNA
  Csmd2
cacaatgcaccacat

SEQ ID NO: 75928 - DNA, 15 bp, Artificial Sequence
  dgRNA
  Csmd2
acaatgcaccacatg

SEQ ID NO: 75929 - DNA, 15 bp, Artificial Sequence
  dgRNA
  Ttc39a
tgcgccgatgctcca

SEQ ID NO: 75930 - DNA, 15 bp, Artificial Sequence
  dgRNA
  Ttc39a
cgatgctccaaggcc

SEQ ID NO: 75931 - DNA, 15 bp, Artificial Sequence
  dgRNA
  Ttc39a
ccgaccttgagcgcc

SEQ ID NO: 75932 - DNA, 15 bp, Artificial Sequence
  dgRNA
  Ttc39a
cgaccttgagcgccc

SEQ ID NO: 75933 - DNA, 15 bp, Artificial Sequence
  dgRNA
  Htr4
ctgccgaacccggct

SEQ ID NO: 75934 - DNA, 15 bp, Artificial Sequence
  dgRNA
  Htr4
gaacccggcttggtt

SEQ ID NO: 75935 - DNA, 15 bp, Artificial Sequence
  dgRNA
  Htr4
ggcttggttaggagc

SEQ ID NO: 75936 - DNA, 15 bp, Artificial Sequence
  dgRNA
  Htr4
gccttttcccgagcg

SEQ ID NO: 75937 - DNA, 15 bp, Artificial Sequence
  dgRNA
  Hormad2
cgcccacagcccggg

SEQ ID NO: 75938 - DNA, 15 bp, Artificial Sequence
  dgRNA
  Hormad2
gcccacagcccgggt

SEQ ID NO: 75939 - DNA, 15 bp, Artificial Sequence
  dgRNA
  Hormad2
gccaaccttagactt

SEQ ID NO: 75940 - DNA, 15 bp, Artificial Sequence
  dgRNA
  Hormad2
aaagtcgtaaagccg

SEQ ID NO: 75941 - DNA, 15 bp, Artificial Sequence
  dgRNA
  Xpo6
tccggaccctgacac

SEQ ID NO: 75942 - DNA, 15 bp, Artificial Sequence
  dgRNA
  Galnt16
tgagacccgggatgc

SEQ ID NO: 75943 - DNA, 15 bp, Artificial Sequence
  dgRNA
  Galnt16
gacccgggatgcggg

SEQ ID NO: 75944 - DNA, 15 bp, Artificial Sequence
  dgRNA
  Galnt16
cgcgccacttcccag

SEQ ID NO: 75945 - DNA, 15 bp, Artificial Sequence
  dgRNA
  Galnt16
gcgccacttcccagc

SEQ ID NO: 75946 - DNA, 15 bp, Artificial Sequence
  dgRNA
  Cfap61
gaactcgagcgatcc

SEQ ID NO: 75947 - DNA, 15 bp, Artificial Sequence
  dgRNA
  Cfap61
atcctggccgacaac

SEQ ID NO: 75948 - DNA, 15 bp, Artificial Sequence
  dgRNA
  Cfap61
aaaagcacttcgaac

SEQ ID NO: 75949 - DNA, 15 bp, Artificial Sequence
  dgRNA
  Cfap61
gcacttcgaaccggc

SEQ ID NO: 75950 - DNA, 15 bp, Artificial Sequence
  dgRNA
  Foxp4
gctttaggcgaatta

SEQ ID NO: 75951 - DNA, 15 bp, Artificial Sequence
  dgRNA
  Foxp4
taattcgcctaaagc

SEQ ID NO: 75952 - DNA, 15 bp, Artificial Sequence
  dgRNA
  Foxp4
cgagcgagcggcgga

SEQ ID NO: 75953 - DNA, 15 bp, Artificial Sequence
  dgRNA
  Foxp4
acgagcgagcggcgg

SEQ ID NO: 75954 - DNA, 15 bp, Artificial Sequence
  dgRNA
  1700006E09Rik
gttatgattcggtca

SEQ ID NO: 75955 - DNA, 15 bp, Artificial Sequence
  dgRNA
  1700006E09Rik
gggtgcgggacaatc

SEQ ID NO: 75956 - DNA, 15 bp, Artificial Sequence
  dgRNA
  1700006E09Rik
gacaagtctcagcgg

SEQ ID NO: 75957 - DNA, 15 bp, Artificial Sequence
  dgRNA
  1700006E09Rik
cccagttatgacatc

SEQ ID NO: 75958 - DNA, 15 bp, Artificial Sequence
  dgRNA
  Sgk2
gtggtgcagcaacca

SEQ ID NO: 75959 - DNA, 15 bp, Artificial Sequence
  dgRNA
  Sgk2
cagttaatgagtaac

SEQ ID NO: 75960 - DNA, 15 bp, Artificial Sequence
  dgRNA
  Sgk2
taatgagtaaccgga

SEQ ID NO: 75961 - DNA, 15 bp, Artificial Sequence
  dgRNA
  Sgk2
cgcagctggcaggac

SEQ ID NO: 75962 - DNA, 15 bp, Artificial Sequence
  dgRNA
  Gnai1
gggggcgctgtccga

SEQ ID NO: 75963 - DNA, 15 bp, Artificial Sequence
  dgRNA
  Gnai1
ccgacggcacgtgcg

SEQ ID NO: 75964 - DNA, 15 bp, Artificial Sequence
  dgRNA
  Gnai1
cgacggcacgtgcgc

SEQ ID NO: 75965 - DNA, 15 bp, Artificial Sequence
  dgRNA
  Gnai1
cggcacgtgcgcggg

SEQ ID NO: 75966 - DNA, 15 bp, Artificial Sequence
  dgRNA
  Nkapl
ctgtccacgccccag

SEQ ID NO: 75967 - DNA, 15 bp, Artificial Sequence
  dgRNA
  Nkapl
agagggctcttgcgc

SEQ ID NO: 75968 - DNA, 15 bp, Artificial Sequence
  dgRNA
  Nkapl
ctcttgcgcaggctc

SEQ ID NO: 75969 - DNA, 15 bp, Artificial Sequence
  dgRNA
  Nkapl
tcttgcgcaggctct

SEQ ID NO: 75970 - DNA, 15 bp, Artificial Sequence
  dgRNA
  Abi2
gcggcgggaatcggg

SEQ ID NO: 75971 - DNA, 15 bp, Artificial Sequence
  dgRNA
  Abi2
gacgcggcgggaatc

SEQ ID NO: 75972 - DNA, 15 bp, Artificial Sequence
  dgRNA
  Abi2
ggacgcggcgggaat

SEQ ID NO: 75973 - DNA, 15 bp, Artificial Sequence
  dgRNA
  Abi2
agcggcggacgcggc

SEQ ID NO: 75974 - DNA, 15 bp, Artificial Sequence
  dgRNA
  Ttc16
gcaaaggccgagcaa

SEQ ID NO: 75975 - DNA, 15 bp, Artificial Sequence
  dgRNA
  Hipk2
ggcgccggccaagtg

SEQ ID NO: 75976 - DNA, 15 bp, Artificial Sequence
  dgRNA
  Hipk2
gccggccaagtgagg

SEQ ID NO: 75977 - DNA, 15 bp, Artificial Sequence
  dgRNA
  Hipk2
agtgaggcggtgatg

SEQ ID NO: 75978 - DNA, 15 bp, Artificial Sequence
  dgRNA
  Hipk2
gtgaggcggtgatgc

SEQ ID NO: 75979 - DNA, 15 bp, Artificial Sequence
  dgRNA
  Lig1
gtagggtcacagctc

SEQ ID NO: 75980 - DNA, 15 bp, Artificial Sequence
  dgRNA
  Lig1
tcacgcaccacgctg

SEQ ID NO: 75981 - DNA, 15 bp, Artificial Sequence
  dgRNA
  Lig1
acgctgtggacttgt

SEQ ID NO: 75982 - DNA, 15 bp, Artificial Sequence
  dgRNA
  Lig1
cgctgtggacttgtt

SEQ ID NO: 75983 - DNA, 15 bp, Artificial Sequence
  dgRNA
  Gpsm2
atctatccgcagcag

SEQ ID NO: 75984 - DNA, 15 bp, Artificial Sequence
  dgRNA
  Gpsm2
gcgctacagtccgag

SEQ ID NO: 75985 - DNA, 15 bp, Artificial Sequence
  dgRNA
  Gpsm2
ccccaccggtgccat

SEQ ID NO: 75986 - DNA, 15 bp, Artificial Sequence
  dgRNA
  Gpsm2
accggtgccattggc

SEQ ID NO: 75987 - DNA, 15 bp, Artificial Sequence
  dgRNA
  Spag6
ctgtgcaccgcctac

SEQ ID NO: 75988 - DNA, 15 bp, Artificial Sequence
  dgRNA
  Spag6
tgtgcaccgcctaca

SEQ ID NO: 75989 - DNA, 15 bp, Artificial Sequence
  dgRNA
  Spag6
ggaagtgacaaccga

SEQ ID NO: 75990 - DNA, 15 bp, Artificial Sequence
  dgRNA
  Spag6
tgtctcgagcaacac

SEQ ID NO: 75991 - DNA, 15 bp, Artificial Sequence
  dgRNA
  Kctd13
aatcgtcacgggttg

SEQ ID NO: 75992 - DNA, 15 bp, Artificial Sequence
  dgRNA
  Kctd13
ccccaacccgcaggc

SEQ ID NO: 75993 - DNA, 15 bp, Artificial Sequence
  dgRNA
  Kctd13
cgactgcgcacgccc

SEQ ID NO: 75994 - DNA, 15 bp, Artificial Sequence
  dgRNA
  Kctd13
gcacgccccggttct

SEQ ID NO: 75995 - DNA, 15 bp, Artificial Sequence
  dgRNA
  Trim68
taattgtctgaaacc

SEQ ID NO: 75996 - DNA, 15 bp, Artificial Sequence
  dgRNA
  Trim68
tgcagctcgtgttcc

SEQ ID NO: 75997 - DNA, 15 bp, Artificial Sequence
  dgRNA
  Trim68
gcagctcgtgttcca

SEQ ID NO: 75998 - DNA, 15 bp, Artificial Sequence
  dgRNA
  Trim68
gattccaatgcgtaa

SEQ ID NO: 75999 - DNA, 15 bp, Artificial Sequence
  dgRNA
  Zfp128
cgcacccgcaggtaa

SEQ ID NO: 76000 - DNA, 15 bp, Artificial Sequence
  dgRNA
  Zfp128
actcccttagaccag

SEQ ID NO: 76001 - DNA, 15 bp, Artificial Sequence
  dgRNA
  Zfp128
cttagaccagaggcc

SEQ ID NO: 76002 - DNA, 15 bp, Artificial Sequence
  dgRNA
  Zfp128
caggccttccccgat

SEQ ID NO: 76003 - DNA, 15 bp, Artificial Sequence
  dgRNA
  Mettl7a1
tgggatggacggtgt

SEQ ID NO: 76004 - DNA, 15 bp, Artificial Sequence
  dgRNA
  Mettl7a1
gagtcaggccgcaat

SEQ ID NO: 76005 - DNA, 15 bp, Artificial Sequence
  dgRNA
  Mettl7a1
aatcggagccctacc

SEQ ID NO: 76006 - DNA, 15 bp, Artificial Sequence
  dgRNA
  Mettl7a1
ccggctctgctattt

SEQ ID NO: 76007 - DNA, 15 bp, Artificial Sequence
  dgRNA
  Ccdc77
gaacctctgccggtg

SEQ ID NO: 76008 - DNA, 15 bp, Artificial Sequence
  dgRNA
  Ccdc77
tgccggtgaggcgca

SEQ ID NO: 76009 - DNA, 15 bp, Artificial Sequence
  dgRNA
  Ccdc77
aggcgcaaggcaaga

SEQ ID NO: 76010 - DNA, 15 bp, Artificial Sequence
  dgRNA
  Ccdc77
ggcgcaaggcaagat

SEQ ID NO: 76011 - DNA, 15 bp, Artificial Sequence
  dgRNA
  Zfp39
tctcaagtcatcgat

SEQ ID NO: 76012 - DNA, 15 bp, Artificial Sequence
  dgRNA
  Zfp39
atctgtggccaatca

SEQ ID NO: 76013 - DNA, 15 bp, Artificial Sequence
  dgRNA
  Zfp39
atcaaggcacgatga

SEQ ID NO: 76014 - DNA, 15 bp, Artificial Sequence
  dgRNA
  Zfp39
tcaaggcacgatgat

SEQ ID NO: 76015 - DNA, 15 bp, Artificial Sequence
  dgRNA
  Rbpj
ggaacccgcggcgag

SEQ ID NO: 76016 - DNA, 15 bp, Artificial Sequence
  dgRNA
  Rbpj
gaacccgcggcgagc

SEQ ID NO: 76017 - DNA, 15 bp, Artificial Sequence
  dgRNA
  Rbpj
gagcgggaagccact

SEQ ID NO: 76018 - DNA, 15 bp, Artificial Sequence
  dgRNA
  Rbpj
cttcccgctcgccgc

SEQ ID NO: 76019 - DNA, 15 bp, Artificial Sequence
  dgRNA
  Shkbp1
cgccccgtcgaaacc

SEQ ID NO: 76020 - DNA, 15 bp, Artificial Sequence
  dgRNA
  Shkbp1
ctgtccaatcgccgg

SEQ ID NO: 76021 - DNA, 15 bp, Artificial Sequence
  dgRNA
  Shkbp1
atcgccggtggatcc

SEQ ID NO: 76022 - DNA, 15 bp, Artificial Sequence
  dgRNA
  Shkbp1
atacataacgaatgt

SEQ ID NO: 76023 - DNA, 15 bp, Artificial Sequence
  dgRNA
  Tmtc4
cctgcgcctccttcg

SEQ ID NO: 76024 - DNA, 15 bp, Artificial Sequence
  dgRNA
  Tmtc4
gacgtcactccgaca

SEQ ID NO: 76025 - DNA, 15 bp, Artificial Sequence
  dgRNA
  Tmtc4
acacggaccaataag

SEQ ID NO: 76026 - DNA, 15 bp, Artificial Sequence
  dgRNA
  Tmtc4
accaataagcggaag

SEQ ID NO: 76027 - DNA, 15 bp, Artificial Sequence
  dgRNA
  Six3
ccccctccggctaag

SEQ ID NO: 76028 - DNA, 15 bp, Artificial Sequence
  dgRNA
  Six3
gttctcagtattgat

SEQ ID NO: 76029 - DNA, 15 bp, Artificial Sequence
  dgRNA
  Six3
tcagtattgattggc

SEQ ID NO: 76030 - DNA, 15 bp, Artificial Sequence
  dgRNA
  Six3
tggcagtggttgccg

SEQ ID NO: 76031 - DNA, 15 bp, Artificial Sequence
  dgRNA
  Eif5
aaactcagagcgagc

SEQ ID NO: 76032 - DNA, 15 bp, Artificial Sequence
  dgRNA
  Eif5
atcgcgagaccgcga

SEQ ID NO: 76033 - DNA, 15 bp, Artificial Sequence
  dgRNA
  Eif5
gaccgcgaaggcctc

SEQ ID NO: 76034 - DNA, 15 bp, Artificial Sequence
  dgRNA
  Eif5
accgcgaaggcctct

SEQ ID NO: 76035 - DNA, 15 bp, Artificial Sequence
  dgRNA
  Lmf1
gagacgcccaccgct

SEQ ID NO: 76036 - DNA, 15 bp, Artificial Sequence
  dgRNA
  Lmf1
agagaccgcccagag

SEQ ID NO: 76037 - DNA, 15 bp, Artificial Sequence
  dgRNA
  Lmf1
gagaccgcccagaga

SEQ ID NO: 76038 - DNA, 15 bp, Artificial Sequence
  dgRNA
  Lmf1
cgcccagagagggcg

SEQ ID NO: 76039 - DNA, 15 bp, Artificial Sequence
  dgRNA
  Rassf8
tgtacaatgctaacc

SEQ ID NO: 76040 - DNA, 15 bp, Artificial Sequence
  dgRNA
  Rassf8
gtacaatgctaacca

SEQ ID NO: 76041 - DNA, 15 bp, Artificial Sequence
  dgRNA
  Rassf8
aatgctaaccagggt

SEQ ID NO: 76042 - DNA, 15 bp, Artificial Sequence
  dgRNA
  Rassf8
cagggtcggcgtgtg

SEQ ID NO: 76043 - DNA, 15 bp, Artificial Sequence
  dgRNA
  Dner
tagctgggcaagtac

SEQ ID NO: 76044 - DNA, 15 bp, Artificial Sequence
  dgRNA
  Dner
aggcgaagaaattgc

SEQ ID NO: 76045 - DNA, 15 bp, Artificial Sequence
  dgRNA
  Dner
caagggccccggtct

SEQ ID NO: 76046 - DNA, 15 bp, Artificial Sequence
  dgRNA
  Dner
ggtcttggatgtgca

SEQ ID NO: 76047 - DNA, 15 bp, Artificial Sequence
  dgRNA
  Med8
agccgtgcgagaaac

SEQ ID NO: 76048 - DNA, 15 bp, Artificial Sequence
  dgRNA
  Med8
tgcgagaaaccggaa

SEQ ID NO: 76049 - DNA, 15 bp, Artificial Sequence
  dgRNA
  Med8
gcgagaaaccggaaa

SEQ ID NO: 76050 - DNA, 15 bp, Artificial Sequence
  dgRNA
  Med8
ttccggtttctcgca

SEQ ID NO: 76051 - DNA, 15 bp, Artificial Sequence
  dgRNA
  Tlr3
cggcctagttgtttc

SEQ ID NO: 76052 - DNA, 15 bp, Artificial Sequence
  dgRNA
  Tlr3
ggcctagttgtttct

SEQ ID NO: 76053 - DNA, 15 bp, Artificial Sequence
  dgRNA
  Tlr3
aaattaggcatcagt

SEQ ID NO: 76054 - DNA, 15 bp, Artificial Sequence
  dgRNA
  Tlr3
gtttggtccagcact

SEQ ID NO: 76055 - DNA, 15 bp, Artificial Sequence
  dgRNA
  Morc2a
gaggtagcggtggcg

SEQ ID NO: 76056 - DNA, 15 bp, Artificial Sequence
  dgRNA
  Morc2a
aggtagcggtggcgc

SEQ ID NO: 76057 - DNA, 15 bp, Artificial Sequence
  dgRNA
  Morc2a
tgtcatcgtctgttg

SEQ ID NO: 76058 - DNA, 15 bp, Artificial Sequence
  dgRNA
  Morc2a
tcgtctgttgaggcg

SEQ ID NO: 76059 - DNA, 15 bp, Artificial Sequence
  dgRNA
  Slc27a3
gggtaggcacctctt

SEQ ID NO: 76060 - DNA, 15 bp, Artificial Sequence
  dgRNA
  Slc27a3
ctctttggacccgac

SEQ ID NO: 76061 - DNA, 15 bp, Artificial Sequence
  dgRNA
  Slc27a3
gacccgacaggctgc

SEQ ID NO: 76062 - DNA, 15 bp, Artificial Sequence
  dgRNA
  Slc27a3
ggagcgtgtgcgcct

SEQ ID NO: 76063 - DNA, 15 bp, Artificial Sequence
  dgRNA
  Gpr83
aaaagtgctgcgagc

SEQ ID NO: 76064 - DNA, 15 bp, Artificial Sequence
  dgRNA
  Gpr83
aaagtgctgcgagcc

SEQ ID NO: 76065 - DNA, 15 bp, Artificial Sequence
  dgRNA
  Gpr83
gggcgagcgccaccg

SEQ ID NO: 76066 - DNA, 15 bp, Artificial Sequence
  dgRNA
  Gpr83
tcggtggcgctcgcc

SEQ ID NO: 76067 - DNA, 15 bp, Artificial Sequence
  dgRNA
  Nub1
gcctgaccctcagcg

SEQ ID NO: 76068 - DNA, 15 bp, Artificial Sequence
  dgRNA
  Nub1
cacagccgcgttttc

SEQ ID NO: 76069 - DNA, 15 bp, Artificial Sequence
  dgRNA
  Nub1
acagccgcgttttca

SEQ ID NO: 76070 - DNA, 15 bp, Artificial Sequence
  dgRNA
  Nub1
cggtggagcggatgt

SEQ ID NO: 76071 - DNA, 15 bp, Artificial Sequence
  dgRNA
  Vip
acctgttcatcccat

SEQ ID NO: 76072 - DNA, 15 bp, Artificial Sequence
  dgRNA
  Vip
tactgtgacgtcttt

SEQ ID NO: 76073 - DNA, 15 bp, Artificial Sequence
  dgRNA
  Vip
actgtgacgtctttc

SEQ ID NO: 76074 - DNA, 15 bp, Artificial Sequence
  dgRNA
  Vip
ctgtgacgtctttcg

SEQ ID NO: 76075 - DNA, 15 bp, Artificial Sequence
  dgRNA
  Fgfbp1
gaagggcttccaagg

SEQ ID NO: 76076 - DNA, 15 bp, Artificial Sequence
  dgRNA
  Fgfbp1
accccccccagccat

SEQ ID NO: 76077 - DNA, 15 bp, Artificial Sequence
  dgRNA
  Fgfbp1
ttgtactatttatac

SEQ ID NO: 76078 - DNA, 15 bp, Artificial Sequence
  dgRNA
  Fgfbp1
ctcacgctggggtgc

SEQ ID NO: 76079 - DNA, 15 bp, Artificial Sequence
  dgRNA
  Zfp365
cgccgcccctgcaac

SEQ ID NO: 76080 - DNA, 15 bp, Artificial Sequence
  dgRNA
  Zfp365
gccgcccctgcaact

SEQ ID NO: 76081 - DNA, 15 bp, Artificial Sequence
  dgRNA
  Zfp365
gcctgtagcaagact

SEQ ID NO: 76082 - DNA, 15 bp, Artificial Sequence
  dgRNA
  Zfp365
gtagcaagactaggc

SEQ ID NO: 76083 - DNA, 15 bp, Artificial Sequence
  dgRNA
  Ssxb6
cccctcatctaatca

SEQ ID NO: 76084 - DNA, 15 bp, Artificial Sequence
  dgRNA
  Ssxb6
ggattgatgatctcg

SEQ ID NO: 76085 - DNA, 15 bp, Artificial Sequence
  dgRNA
  Ssxb6
gggggagtacaattg

SEQ ID NO: 76086 - DNA, 15 bp, Artificial Sequence
  dgRNA
  Ssxb6
agggggagtacaatt

SEQ ID NO: 76087 - DNA, 15 bp, Artificial Sequence
  dgRNA
  AI607873
gaggtttccctagcc

SEQ ID NO: 76088 - DNA, 15 bp, Artificial Sequence
  dgRNA
  AI607873
caaatggatgtacac

SEQ ID NO: 76089 - DNA, 15 bp, Artificial Sequence
  dgRNA
  AI607873
cgatttccctggcta

SEQ ID NO: 76090 - DNA, 15 bp, Artificial Sequence
  dgRNA
  AI607873
aattttcgatttccc

SEQ ID NO: 76091 - DNA, 15 bp, Artificial Sequence
  dgRNA
  Olfr1324
ctctcactatgtact

SEQ ID NO: 76092 - DNA, 15 bp, Artificial Sequence
  dgRNA
  Olfr1324
agtgtgatatactga

SEQ ID NO: 76093 - DNA, 15 bp, Artificial Sequence
  dgRNA
  Olfr1324
gtgtgatatactgat

SEQ ID NO: 76094 - DNA, 15 bp, Artificial Sequence
  dgRNA
  Atp6v0c
gagaagacgactgcg

SEQ ID NO: 76095 - DNA, 15 bp, Artificial Sequence
  dgRNA
  Atp6v0c
gactgcgtggagccg

SEQ ID NO: 76096 - DNA, 15 bp, Artificial Sequence
  dgRNA
  Atp6v0c
actgcgtggagccgc

SEQ ID NO: 76097 - DNA, 15 bp, Artificial Sequence
  dgRNA
  Atp6v0c
ggccagcgaagaccc

SEQ ID NO: 76098 - DNA, 15 bp, Artificial Sequence
  dgRNA
  Tldc2
cacagacccaccccg

SEQ ID NO: 76099 - DNA, 15 bp, Artificial Sequence
  dgRNA
  Tldc2
caccccgtggccact

SEQ ID NO: 76100 - DNA, 15 bp, Artificial Sequence
  dgRNA
  Tldc2
cgtggccacttggcc

SEQ ID NO: 76101 - DNA, 15 bp, Artificial Sequence
  dgRNA
  Tldc2
gagcaaagggcggct

SEQ ID NO: 76102 - DNA, 15 bp, Artificial Sequence
  dgRNA
  Stat2
gccaatcactgaagt

SEQ ID NO: 76103 - DNA, 15 bp, Artificial Sequence
  dgRNA
  Stat2
aatcactgaagtcgg

SEQ ID NO: 76104 - DNA, 15 bp, Artificial Sequence
  dgRNA
  Stat2
ctgaagtcggcggtg

SEQ ID NO: 76105 - DNA, 15 bp, Artificial Sequence
  dgRNA
  Stat2
gcccagcgctgaacg

SEQ ID NO: 76106 - DNA, 15 bp, Artificial Sequence
  dgRNA
  Cst8
catgaattccccagt

SEQ ID NO: 76107 - DNA, 15 bp, Artificial Sequence
  dgRNA
  Cst8
aattccccagttgga

SEQ ID NO: 76108 - DNA, 15 bp, Artificial Sequence
  dgRNA
  Cst8
agagcttggacccaa

SEQ ID NO: 76109 - DNA, 15 bp, Artificial Sequence
  dgRNA
  Cst8
ggacccaaaggctag

SEQ ID NO: 76110 - DNA, 15 bp, Artificial Sequence
  dgRNA
  Nf2
aggacctgtttgatt

SEQ ID NO: 76111 - DNA, 15 bp, Artificial Sequence
  dgRNA
  Nf2
tggtgtgccggacac

SEQ ID NO: 76112 - DNA, 15 bp, Artificial Sequence
  dgRNA
  Nf2
ggtgtgccggacact

SEQ ID NO: 76113 - DNA, 15 bp, Artificial Sequence
  dgRNA
  Nf2
gtgtgccggacactg

SEQ ID NO: 76114 - DNA, 15 bp, Artificial Sequence
  dgRNA
  Mnat1
atgtaattaggcaag

SEQ ID NO: 76115 - DNA, 15 bp, Artificial Sequence
  dgRNA
  Mnat1
gattcacctaaggtt

SEQ ID NO: 76116 - DNA, 15 bp, Artificial Sequence
  dgRNA
  Mnat1
tggaactgtagcggc

SEQ ID NO: 76117 - DNA, 15 bp, Artificial Sequence
  dgRNA
  Mnat1
ctgtagcggctggaa

SEQ ID NO: 76118 - DNA, 15 bp, Artificial Sequence
  dgRNA
  Eri1
tcacgcgcgcatccc

SEQ ID NO: 76119 - DNA, 15 bp, Artificial Sequence
  dgRNA
  Eri1
cgcatcccaggcaac

SEQ ID NO: 76120 - DNA, 15 bp, Artificial Sequence
  dgRNA
  Eri1
ccattttcgaacctg

SEQ ID NO: 76121 - DNA, 15 bp, Artificial Sequence
  dgRNA
  Eri1
cattttcgaacctgc

SEQ ID NO: 76122 - DNA, 15 bp, Artificial Sequence
  dgRNA
  Sox9
tctcgtcacccaacc

SEQ ID NO: 76123 - DNA, 15 bp, Artificial Sequence
  dgRNA
  Sox9
agagctagccgtgat

SEQ ID NO: 76124 - DNA, 15 bp, Artificial Sequence
  dgRNA
  Sox9
gccgtgattggcccg

SEQ ID NO: 76125 - DNA, 15 bp, Artificial Sequence
  dgRNA
  Sox9
aggtatctaacgtga

SEQ ID NO: 76126 - DNA, 15 bp, Artificial Sequence
  dgRNA
  Myog
tgcacaggagccgcc

SEQ ID NO: 76127 - DNA, 15 bp, Artificial Sequence
  dgRNA
  Myog
gcacaggagccgcct

SEQ ID NO: 76128 - DNA, 15 bp, Artificial Sequence
  dgRNA
  Myog
gagccgcctgggcca

SEQ ID NO: 76129 - DNA, 15 bp, Artificial Sequence
  dgRNA
  Myog
gcaacagcttagagg

SEQ ID NO: 76130 - DNA, 15 bp, Artificial Sequence
  dgRNA
  Dcaf11
gtgaagctaaactgg

SEQ ID NO: 76131 - DNA, 15 bp, Artificial Sequence
  dgRNA
  Dcaf11
gacttctaacctcat

SEQ ID NO: 76132 - DNA, 15 bp, Artificial Sequence
  dgRNA
  Dcaf11
gagttctaacgcctc

SEQ ID NO: 76133 - DNA, 15 bp, Artificial Sequence
  dgRNA
  Dcaf11
tctaacgcctctggt

SEQ ID NO: 76134 - DNA, 15 bp, Artificial Sequence
  dgRNA
  Copg1
cctggctgaatttaa

SEQ ID NO: 76135 - DNA, 15 bp, Artificial Sequence
  dgRNA
  Trim66
cgtgctgcagcagtg

SEQ ID NO: 76136 - DNA, 15 bp, Artificial Sequence
  dgRNA
  Trim66
aggcaccgctgctgc

SEQ ID NO: 76137 - DNA, 15 bp, Artificial Sequence
  dgRNA
  Trim66
agccccctgtactgc

SEQ ID NO: 76138 - DNA, 15 bp, Artificial Sequence
  dgRNA
  Trim66
cagcacgcagatgcc

SEQ ID NO: 76139 - DNA, 15 bp, Artificial Sequence
  dgRNA
  Olfr98
cttgttattctatca

SEQ ID NO: 76140 - DNA, 15 bp, Artificial Sequence
  dgRNA
  Olfr98
ttgctcaatgttgtg

SEQ ID NO: 76141 - DNA, 15 bp, Artificial Sequence
  dgRNA
  Olfr98
aattctctgggtgaa

SEQ ID NO: 76142 - DNA, 15 bp, Artificial Sequence
  dgRNA
  Olfr98
cacaacattgagcaa

SEQ ID NO: 76143 - DNA, 15 bp, Artificial Sequence
  dgRNA
  Ccar1
accacaagatggcgg

SEQ ID NO: 76144 - DNA, 15 bp, Artificial Sequence
  dgRNA
  Ccar1
tggcggcggcgacac

SEQ ID NO: 76145 - DNA, 15 bp, Artificial Sequence
  dgRNA
  Ccar1
ggcggcgacaccggc

SEQ ID NO: 76146 - DNA, 15 bp, Artificial Sequence
  dgRNA
  Ccar1
cgttggcctcagagc

SEQ ID NO: 76147 - DNA, 15 bp, Artificial Sequence
  dgRNA
  Ina
ggggtacaggcgcag

SEQ ID NO: 76148 - DNA, 15 bp, Artificial Sequence
  dgRNA
  Ina
acaggcgcagcggac

SEQ ID NO: 76149 - DNA, 15 bp, Artificial Sequence
  dgRNA
  Ina
caggcgcagcggaca

SEQ ID NO: 76150 - DNA, 15 bp, Artificial Sequence
  dgRNA
  Ina
cgcagcggacaggga

SEQ ID NO: 76151 - DNA, 15 bp, Artificial Sequence
  dgRNA
  Serpinb2
gctcagaagataacg

SEQ ID NO: 76152 - DNA, 15 bp, Artificial Sequence
  dgRNA
  Serpinb2
ggacaaggtaatgac

SEQ ID NO: 76153 - DNA, 15 bp, Artificial Sequence
  dgRNA
  Serpinb2
gagcggctgacacac

SEQ ID NO: 76154 - DNA, 15 bp, Artificial Sequence
  dgRNA
  Serpinb2
tcgttatcttctgag

SEQ ID NO: 76155 - DNA, 15 bp, Artificial Sequence
  dgRNA
  Stau2
gagagagctggcgcg

SEQ ID NO: 76156 - DNA, 15 bp, Artificial Sequence
  dgRNA
  Stau2
cgcgcggcgtggcgc

SEQ ID NO: 76157 - DNA, 15 bp, Artificial Sequence
  dgRNA
  Ampd2
atcgcccaagaccaa

SEQ ID NO: 76158 - DNA, 15 bp, Artificial Sequence
  dgRNA
  Ampd2
tcgcccaagaccaaa

SEQ ID NO: 76159 - DNA, 15 bp, Artificial Sequence
  dgRNA
  Ampd2
aggccaaccctggtc

SEQ ID NO: 76160 - DNA, 15 bp, Artificial Sequence
  dgRNA
  Ampd2
ccaaccctggtccgg

SEQ ID NO: 76161 - DNA, 15 bp, Artificial Sequence
  dgRNA
  Cntnap2
tattaggcgtctcct

SEQ ID NO: 76162 - DNA, 15 bp, Artificial Sequence
  dgRNA
  Cntnap2
attaggcgtctcctt

SEQ ID NO: 76163 - DNA, 15 bp, Artificial Sequence
  dgRNA
  Cntnap2
ggctaccaataatcc

SEQ ID NO: 76164 - DNA, 15 bp, Artificial Sequence
  dgRNA
  Cntnap2
ttacctaccttcctc

SEQ ID NO: 76165 - DNA, 15 bp, Artificial Sequence
  dgRNA
  Nap1l1
ccatcgcagcgtaga

SEQ ID NO: 76166 - DNA, 15 bp, Artificial Sequence
  dgRNA
  Nap1l1
catcgcagcgtagaa

SEQ ID NO: 76167 - DNA, 15 bp, Artificial Sequence
  dgRNA
  Nap1l1
gcacaagaccgccac

SEQ ID NO: 76168 - DNA, 15 bp, Artificial Sequence
  dgRNA
  Nap1l1
aagaccgccacaggc

SEQ ID NO: 76169 - DNA, 15 bp, Artificial Sequence
  dgRNA
  Chrnd
gtgacaatccctgcc

SEQ ID NO: 76170 - DNA, 15 bp, Artificial Sequence
  dgRNA
  Chrnd
ttttcgttctgccct

SEQ ID NO: 76171 - DNA, 15 bp, Artificial Sequence
  dgRNA
  Chrnd
atcagattgcgtttc

SEQ ID NO: 76172 - DNA, 15 bp, Artificial Sequence
  dgRNA
  Chrnd
gattgttggtagggt

SEQ ID NO: 76173 - DNA, 15 bp, Artificial Sequence
  dgRNA
  Fam134a
aagggggcgcacgca

SEQ ID NO: 76174 - DNA, 15 bp, Artificial Sequence
  dgRNA
  Cmpk2
ggaattctcaagagc

SEQ ID NO: 76175 - DNA, 15 bp, Artificial Sequence
  dgRNA
  Cmpk2
agagcaggcgttgcc

SEQ ID NO: 76176 - DNA, 15 bp, Artificial Sequence
  dgRNA
  Cmpk2
acccgccagagcccc

SEQ ID NO: 76177 - DNA, 15 bp, Artificial Sequence
  dgRNA
  Cmpk2
gctgccgacagttaa

SEQ ID NO: 76178 - DNA, 15 bp, Artificial Sequence
  dgRNA
  Tmem74
gctcgaagctcaggc

SEQ ID NO: 76179 - DNA, 15 bp, Artificial Sequence
  dgRNA
  Tmem74
cgggatgctcagcag

SEQ ID NO: 76180 - DNA, 15 bp, Artificial Sequence
  dgRNA
  Tmem74
ccgccctgcccgatt

SEQ ID NO: 76181 - DNA, 15 bp, Artificial Sequence
  dgRNA
  Tmem74
ccctgcccgattcgg

SEQ ID NO: 76182 - DNA, 15 bp, Artificial Sequence
  dgRNA
  2900092C05Rik
gcccaagttctgtga

SEQ ID NO: 76183 - DNA, 15 bp, Artificial Sequence
  dgRNA
  2900092C05Rik
gattccagggtagtt

SEQ ID NO: 76184 - DNA, 15 bp, Artificial Sequence
  dgRNA
  2900092C05Rik
ttaccctaactaccc

SEQ ID NO: 76185 - DNA, 15 bp, Artificial Sequence
  dgRNA
  2900092C05Rik
aacgcccccagtgtg

SEQ ID NO: 76186 - DNA, 15 bp, Artificial Sequence
  dgRNA
  Serpina3n
ggggcttttcccatc

SEQ ID NO: 76187 - DNA, 15 bp, Artificial Sequence
  dgRNA
  Serpina3n
tggggacaacatgcc

SEQ ID NO: 76188 - DNA, 15 bp, Artificial Sequence
  dgRNA
  H1f0
gccgctccgccaggt

SEQ ID NO: 76189 - DNA, 15 bp, Artificial Sequence
  dgRNA
  H1f0
ccgctccgccaggtt

SEQ ID NO: 76190 - DNA, 15 bp, Artificial Sequence
  dgRNA
  H1f0
cgctccgccaggttg

SEQ ID NO: 76191 - DNA, 15 bp, Artificial Sequence
  dgRNA
  H1f0
gctccgccaggttgg

SEQ ID NO: 76192 - DNA, 15 bp, Artificial Sequence
  dgRNA
  Gnat2
acacacatcgtgcta

SEQ ID NO: 76193 - DNA, 15 bp, Artificial Sequence
  dgRNA
  Gnat2
accagtaatagctcc

SEQ ID NO: 76194 - DNA, 15 bp, Artificial Sequence
  dgRNA
  Gnat2
tccaggagctattac

SEQ ID NO: 76195 - DNA, 15 bp, Artificial Sequence
  dgRNA
  Cd320
gcctagaggccgctc

SEQ ID NO: 76196 - DNA, 15 bp, Artificial Sequence
  dgRNA
  Cd320
aggccgctccggctc

SEQ ID NO: 76197 - DNA, 15 bp, Artificial Sequence
  dgRNA
  Cd320
gctccggcccatacc

SEQ ID NO: 76198 - DNA, 15 bp, Artificial Sequence
  dgRNA
  Cd320
ctccggcccataccc

SEQ ID NO: 76199 - DNA, 15 bp, Artificial Sequence
  dgRNA
  Crx
gactcactgggcaac

SEQ ID NO: 76200 - DNA, 15 bp, Artificial Sequence
  dgRNA
  Romo1
cccgggtgggcaccg

SEQ ID NO: 76201 - DNA, 15 bp, Artificial Sequence
  dgRNA
  Romo1
accgaggaccttccc

SEQ ID NO: 76202 - DNA, 15 bp, Artificial Sequence
  dgRNA
  Romo1
acgcccgcctccaag

SEQ ID NO: 76203 - DNA, 15 bp, Artificial Sequence
  dgRNA
  Romo1
agagcccaccatccg

SEQ ID NO: 76204 - DNA, 15 bp, Artificial Sequence
  dgRNA
  Scn1b
tgcccgggcgcctcc

SEQ ID NO: 76205 - DNA, 15 bp, Artificial Sequence
  dgRNA
  Scn1b
cctcccgggccgctg

SEQ ID NO: 76206 - DNA, 15 bp, Artificial Sequence
  dgRNA
  Scn1b
gggccgctgcggcaa

SEQ ID NO: 76207 - DNA, 15 bp, Artificial Sequence
  dgRNA
  Scn1b
cgctgcggcaaaggc

SEQ ID NO: 76208 - DNA, 15 bp, Artificial Sequence
  dgRNA
  Atp1a1
cagacacccgcgtcc

SEQ ID NO: 76209 - DNA, 15 bp, Artificial Sequence
  dgRNA
  Atp1a1
agacacccgcgtcct

SEQ ID NO: 76210 - DNA, 15 bp, Artificial Sequence
  dgRNA
  Atp1a1
ccgcgtcctgggcac

SEQ ID NO: 76211 - DNA, 15 bp, Artificial Sequence
  dgRNA
  Atp1a1
ccggcgccctcctgc

SEQ ID NO: 76212 - DNA, 15 bp, Artificial Sequence
  dgRNA
  Tpte
ttttaggggaaggtc

SEQ ID NO: 76213 - DNA, 15 bp, Artificial Sequence
  dgRNA
  Fdx1
cgccccgcgaaggcg

SEQ ID NO: 76214 - DNA, 15 bp, Artificial Sequence
  dgRNA
  Fdx1
gcgaaggcgtggcag

SEQ ID NO: 76215 - DNA, 15 bp, Artificial Sequence
  dgRNA
  Fdx1
ggcgtggcagcggcg

SEQ ID NO: 76216 - DNA, 15 bp, Artificial Sequence
  dgRNA
  Fdx1
gtggcagcggcgagg

SEQ ID NO: 76217 - DNA, 15 bp, Artificial Sequence
  dgRNA
  Tfap2c
aaccttgaccatggc

SEQ ID NO: 76218 - DNA, 15 bp, Artificial Sequence
  dgRNA
  Tfap2c
accttgaccatggcc

SEQ ID NO: 76219 - DNA, 15 bp, Artificial Sequence
  dgRNA
  Tfap2c
tgaccatggccgggc

SEQ ID NO: 76220 - DNA, 15 bp, Artificial Sequence
  dgRNA
  Tfap2c
ttcctaaggcgcaga

SEQ ID NO: 76221 - DNA, 15 bp, Artificial Sequence
  dgRNA
  6430548M08Rik
ggtaggctccaggtc

SEQ ID NO: 76222 - DNA, 15 bp, Artificial Sequence
  dgRNA
  6430548M08Rik
ccacctggatatcaa

SEQ ID NO: 76223 - DNA, 15 bp, Artificial Sequence
  dgRNA
  6430548M08Rik
ttctcagtctctgcg

SEQ ID NO: 76224 - DNA, 15 bp, Artificial Sequence
  dgRNA
  Gm28040
ctttgacctaggctc

SEQ ID NO: 76225 - DNA, 15 bp, Artificial Sequence
  dgRNA
  Gm28040
gtacgaactctgacc

SEQ ID NO: 76226 - DNA, 15 bp, Artificial Sequence
  dgRNA
  Spesp1
caggcttttcaaccg

SEQ ID NO: 76227 - DNA, 15 bp, Artificial Sequence
  dgRNA
  Spesp1
tgcgtaacacgcacg

SEQ ID NO: 76228 - DNA, 15 bp, Artificial Sequence
  dgRNA
  Spesp1
ctggggcaaccgttg

SEQ ID NO: 76229 - DNA, 15 bp, Artificial Sequence
  dgRNA
  Spesp1
tggggcaaccgttgc

SEQ ID NO: 76230 - DNA, 15 bp, Artificial Sequence
  dgRNA
  Neurl4
cggccgtattccccc

SEQ ID NO: 76231 - DNA, 15 bp, Artificial Sequence
  dgRNA
  Neurl4
ggccgtattccccca

SEQ ID NO: 76232 - DNA, 15 bp, Artificial Sequence
  dgRNA
  Neurl4
ttcccccagggcgtc

SEQ ID NO: 76233 - DNA, 15 bp, Artificial Sequence
  dgRNA
  Neurl4
ggcgtctggccgccg

SEQ ID NO: 76234 - DNA, 15 bp, Artificial Sequence
  dgRNA
  Psmd8
caccccttgacgtag

SEQ ID NO: 76235 - DNA, 15 bp, Artificial Sequence
  dgRNA
  Psmd8
cccttgacgtagagg

SEQ ID NO: 76236 - DNA, 15 bp, Artificial Sequence
  dgRNA
  Psmd8
gcggtacccttaaga

SEQ ID NO: 76237 - DNA, 15 bp, Artificial Sequence
  dgRNA
  Psmd8
agatggacattccac

SEQ ID NO: 76238 - DNA, 15 bp, Artificial Sequence
  dgRNA
  Mctp2
ccttcgtgtcacacc

SEQ ID NO: 76239 - DNA, 15 bp, Artificial Sequence
  dgRNA
  Mctp2
tgcccccgcgctagc

SEQ ID NO: 76240 - DNA, 15 bp, Artificial Sequence
  dgRNA
  Mctp2
gcccccgcgctagct

SEQ ID NO: 76241 - DNA, 15 bp, Artificial Sequence
  dgRNA
  Mctp2
cccgcgctagctggg

SEQ ID NO: 76242 - DNA, 15 bp, Artificial Sequence
  dgRNA
  Tm4sf20
aacatcctgccctac

SEQ ID NO: 76243 - DNA, 15 bp, Artificial Sequence
  dgRNA
  Tm4sf20
ctttaaccagaacgt

SEQ ID NO: 76244 - DNA, 15 bp, Artificial Sequence
  dgRNA
  Tm4sf20
tttaaccagaacgtt

SEQ ID NO: 76245 - DNA, 15 bp, Artificial Sequence
  dgRNA
  Tm4sf20
gaacgttgggataaa

SEQ ID NO: 76246 - DNA, 15 bp, Artificial Sequence
  dgRNA
  Fkbp8
tgaagctgtttcccg

SEQ ID NO: 76247 - DNA, 15 bp, Artificial Sequence
  dgRNA
  Fkbp8
ctgtttcccgaggcg

SEQ ID NO: 76248 - DNA, 15 bp, Artificial Sequence
  dgRNA
  Fkbp8
tttcccgaggcgcgg

SEQ ID NO: 76249 - DNA, 15 bp, Artificial Sequence
  dgRNA
  Fkbp8
gcacaggaccccgag

SEQ ID NO: 76250 - DNA, 15 bp, Artificial Sequence
  dgRNA
  Rbm15b
caagggggccaactc

SEQ ID NO: 76251 - DNA, 15 bp, Artificial Sequence
  dgRNA
  Rbm15b
gtttcttcaatctag

SEQ ID NO: 76252 - DNA, 15 bp, Artificial Sequence
  dgRNA
  Rbm15b
cttcaatctagtggc

SEQ ID NO: 76253 - DNA, 15 bp, Artificial Sequence
  dgRNA
  Rbm15b
aatctagtggcaggt

SEQ ID NO: 76254 - DNA, 15 bp, Artificial Sequence
  dgRNA
  Slc6a9
gcggcgctactgcaa

SEQ ID NO: 76255 - DNA, 15 bp, Artificial Sequence
  dgRNA
  Slc6a9
cggcgctactgcaaa

SEQ ID NO: 76256 - DNA, 15 bp, Artificial Sequence
  dgRNA
  Slc6a9
tcttgacgtctctct

SEQ ID NO: 76257 - DNA, 15 bp, Artificial Sequence
  dgRNA
  Slc6a9
cttgacgtctctcta

SEQ ID NO: 76258 - DNA, 15 bp, Artificial Sequence
  dgRNA
  Tmppe
gccgggacaggctga

SEQ ID NO: 76259 - DNA, 15 bp, Artificial Sequence
  dgRNA
  Tmppe
catcattgctcattc

SEQ ID NO: 76260 - DNA, 15 bp, Artificial Sequence
  dgRNA
  Tmppe
ggggtgccgccattc

SEQ ID NO: 76261 - DNA, 15 bp, Artificial Sequence
  dgRNA
  Tmppe
tgccgccattccgga

SEQ ID NO: 76262 - DNA, 15 bp, Artificial Sequence
  dgRNA
  Gpr82
tacagttctagccag

SEQ ID NO: 76263 - DNA, 15 bp, Artificial Sequence
  dgRNA
  Gpr82
tcgactgtataaccc

SEQ ID NO: 76264 - DNA, 15 bp, Artificial Sequence
  dgRNA
  Gpr82
gtgttaactgatgca

SEQ ID NO: 76265 - DNA, 15 bp, Artificial Sequence
  dgRNA
  Gpr82
cgaacgatgggcagg

SEQ ID NO: 76266 - DNA, 15 bp, Artificial Sequence
  dgRNA
  Pcdhga2
accaatcccactgaa

SEQ ID NO: 76267 - DNA, 15 bp, Artificial Sequence
  dgRNA
  Pcdhga2
tttgtccgcagcttc

SEQ ID NO: 76268 - DNA, 15 bp, Artificial Sequence
  dgRNA
  Pcdhga2
aacagcgacgctcag

SEQ ID NO: 76269 - DNA, 15 bp, Artificial Sequence
  dgRNA
  Pcdhga2
cttttactccttagg

SEQ ID NO: 76270 - DNA, 15 bp, Artificial Sequence
  dgRNA
  Mettl13
cctcgcgctctcagc

SEQ ID NO: 76271 - DNA, 15 bp, Artificial Sequence
  dgRNA
  Mettl13
ctcgcgctctcagct

SEQ ID NO: 76272 - DNA, 15 bp, Artificial Sequence
  dgRNA
  Mettl13
tcgcgctctcagctg

SEQ ID NO: 76273 - DNA, 15 bp, Artificial Sequence
  dgRNA
  Mettl13
gcgcgcagccccgcc

SEQ ID NO: 76274 - DNA, 15 bp, Artificial Sequence
  dgRNA
  Epx
ggtaatggtggctag

SEQ ID NO: 76275 - DNA, 15 bp, Artificial Sequence
  dgRNA
  Epx
ttggtaaagtatgat

SEQ ID NO: 76276 - DNA, 15 bp, Artificial Sequence
  dgRNA
  Epx
ccagagctccgcctt

SEQ ID NO: 76277 - DNA, 15 bp, Artificial Sequence
  dgRNA
  Epx
cagagctccgcctta

SEQ ID NO: 76278 - DNA, 15 bp, Artificial Sequence
  dgRNA
  Champ1
gaacgcatccttatt

SEQ ID NO: 76279 - DNA, 15 bp, Artificial Sequence
  dgRNA
  Champ1
gcatccttattagga

SEQ ID NO: 76280 - DNA, 15 bp, Artificial Sequence
  dgRNA
  Champ1
ccggcacagcccagc

SEQ ID NO: 76281 - DNA, 15 bp, Artificial Sequence
  dgRNA
  Champ1
cggcacagcccagct

SEQ ID NO: 76282 - DNA, 15 bp, Artificial Sequence
  dgRNA
  Olfr1335
gtgtctggactgcgg

SEQ ID NO: 76283 - DNA, 15 bp, Artificial Sequence
  dgRNA
  Olfr1335
tgcggaggtaagagc

SEQ ID NO: 76284 - DNA, 15 bp, Artificial Sequence
  dgRNA
  Olfr1335
gcggaggtaagagct

SEQ ID NO: 76285 - DNA, 15 bp, Artificial Sequence
  dgRNA
  Olfr1335
ctaggtccacttctc

SEQ ID NO: 76286 - DNA, 15 bp, Artificial Sequence
  dgRNA
  Ptpdc1
ctgtccgccgcgtca

SEQ ID NO: 76287 - DNA, 15 bp, Artificial Sequence
  dgRNA
  Ptpdc1
tgtccgccgcgtcac

SEQ ID NO: 76288 - DNA, 15 bp, Artificial Sequence
  dgRNA
  Ptpdc1
gcctcgagtctccat

SEQ ID NO: 76289 - DNA, 15 bp, Artificial Sequence
  dgRNA
  Ptpdc1
cgagtctccattggc

SEQ ID NO: 76290 - DNA, 15 bp, Artificial Sequence
  dgRNA
  Gzma
caacagcactactgc

SEQ ID NO: 76291 - DNA, 15 bp, Artificial Sequence
  dgRNA
  Gzma
ttccagctctacacc

SEQ ID NO: 76292 - DNA, 15 bp, Artificial Sequence
  dgRNA
  Gzma
gctgcccggtggaga

SEQ ID NO: 76293 - DNA, 15 bp, Artificial Sequence
  dgRNA
  Gzma
gtttgtgctgcccgg

SEQ ID NO: 76294 - DNA, 15 bp, Artificial Sequence
  dgRNA
  Schip1
caattaacctgcctc

SEQ ID NO: 76295 - DNA, 15 bp, Artificial Sequence
  dgRNA
  Schip1
ttaaggccaagacac

SEQ ID NO: 76296 - DNA, 15 bp, Artificial Sequence
  dgRNA
  Schip1
cacaagaatagcgct

SEQ ID NO: 76297 - DNA, 15 bp, Artificial Sequence
  dgRNA
  Schip1
ttcaccatataagga

SEQ ID NO: 76298 - DNA, 15 bp, Artificial Sequence
  dgRNA
  Gm12887
acataccagtcaagt

SEQ ID NO: 76299 - DNA, 15 bp, Artificial Sequence
  dgRNA
  Gm12887
tgccctgaaggggcg

SEQ ID NO: 76300 - DNA, 15 bp, Artificial Sequence
  dgRNA
  Gm12887
acctcaaactctgca

SEQ ID NO: 76301 - DNA, 15 bp, Artificial Sequence
  dgRNA
  Gm12887
accttgcagagtttg

SEQ ID NO: 76302 - DNA, 15 bp, Artificial Sequence
  dgRNA
  Scn11a
gcactgattaaagaa

SEQ ID NO: 76303 - DNA, 15 bp, Artificial Sequence
  dgRNA
  Scn11a
agagcgagaatctcc

SEQ ID NO: 76304 - DNA, 15 bp, Artificial Sequence
  dgRNA
  Scn11a
tttaaagagtcgtga

SEQ ID NO: 76305 - DNA, 15 bp, Artificial Sequence
  dgRNA
  Scn11a
ctcgctcttggcagt

SEQ ID NO: 76306 - DNA, 15 bp, Artificial Sequence
  dgRNA
  Copz1
agtgactacgctgac

SEQ ID NO: 76307 - DNA, 15 bp, Artificial Sequence
  dgRNA
  Copz1
ctggtcaagacgcga

SEQ ID NO: 76308 - DNA, 15 bp, Artificial Sequence
  dgRNA
  Copz1
tcaagacgcgaaggc

SEQ ID NO: 76309 - DNA, 15 bp, Artificial Sequence
  dgRNA
  Copz1
gttgcctctttgagg

SEQ ID NO: 76310 - DNA, 15 bp, Artificial Sequence
  dgRNA
  Abca8b
cgttatacagccaca

SEQ ID NO: 76311 - DNA, 15 bp, Artificial Sequence
  dgRNA
  Abca8b
gtgaccaaatataac

SEQ ID NO: 76312 - DNA, 15 bp, Artificial Sequence
  dgRNA
  Abca8b
actggcaccgccctg

SEQ ID NO: 76313 - DNA, 15 bp, Artificial Sequence
  dgRNA
  Abca8b
ctggcaccgccctgc

SEQ ID NO: 76314 - DNA, 15 bp, Artificial Sequence
  dgRNA
  Ccdc64
gcagctgagcccccc

SEQ ID NO: 76315 - DNA, 15 bp, Artificial Sequence
  dgRNA
  Ccdc64
cagctgagccccccg

SEQ ID NO: 76316 - DNA, 15 bp, Artificial Sequence
  dgRNA
  Ccdc64
agctgagccccccgg

SEQ ID NO: 76317 - DNA, 15 bp, Artificial Sequence
  dgRNA
  Ccdc64
tgagccccccggggg

SEQ ID NO: 76318 - DNA, 15 bp, Artificial Sequence
  dgRNA
  Olfr552
tgactctgctgatag

SEQ ID NO: 76319 - DNA, 15 bp, Artificial Sequence
  dgRNA
  Olfr552
atagtggatcctctg

SEQ ID NO: 76320 - DNA, 15 bp, Artificial Sequence
  dgRNA
  Dmkn
tgtccctgatgacgg

SEQ ID NO: 76321 - DNA, 15 bp, Artificial Sequence
  dgRNA
  Dmkn
caatcctgagttggg

SEQ ID NO: 76322 - DNA, 15 bp, Artificial Sequence
  dgRNA
  Dmkn
gctatgagtcatgga

SEQ ID NO: 76323 - DNA, 15 bp, Artificial Sequence
  dgRNA
  Dmkn
ctaggataaaatccc

SEQ ID NO: 76324 - DNA, 15 bp, Artificial Sequence
  dgRNA
  Zfp800
accctcctccgcccg

SEQ ID NO: 76325 - DNA, 15 bp, Artificial Sequence
  dgRNA
  Zfp800
tcctccgcccgaggc

SEQ ID NO: 76326 - DNA, 15 bp, Artificial Sequence
  dgRNA
  Zfp800
gcgtcgcctccccac

SEQ ID NO: 76327 - DNA, 15 bp, Artificial Sequence
  dgRNA
  Zfp800
tgcgcgccgcgctgc

SEQ ID NO: 76328 - DNA, 15 bp, Artificial Sequence
  dgRNA
  Wdr13
gcctcggtccttgta

SEQ ID NO: 76329 - DNA, 15 bp, Artificial Sequence
  dgRNA
  Wdr13
cctcggtccttgtat

SEQ ID NO: 76330 - DNA, 15 bp, Artificial Sequence
  dgRNA
  Wdr13
tttaatgcgcctgcg

SEQ ID NO: 76331 - DNA, 15 bp, Artificial Sequence
  dgRNA
  Wdr13
gaggctcccacgccc

SEQ ID NO: 76332 - DNA, 15 bp, Artificial Sequence
  dgRNA
  Pfpl
taagtcctcatgtcc

SEQ ID NO: 76333 - DNA, 15 bp, Artificial Sequence
  dgRNA
  Pfpl
gcttactaaggttgg

SEQ ID NO: 76334 - DNA, 15 bp, Artificial Sequence
  dgRNA
  Pfpl
ctcattggcttacta

SEQ ID NO: 76335 - DNA, 15 bp, Artificial Sequence
  dgRNA
  Dis3l2
tctccctagcaactg

SEQ ID NO: 76336 - DNA, 15 bp, Artificial Sequence
  dgRNA
  Dis3l2
ctccctagcaactgc

SEQ ID NO: 76337 - DNA, 15 bp, Artificial Sequence
  dgRNA
  Dis3l2
ggagaatgcgcttcc

SEQ ID NO: 76338 - DNA, 15 bp, Artificial Sequence
  dgRNA
  Dis3l2
gggagaatgcgcttc

SEQ ID NO: 76339 - DNA, 15 bp, Artificial Sequence
  dgRNA
  Il2ra
gcctgtacaaggaaa

SEQ ID NO: 76340 - DNA, 15 bp, Artificial Sequence
  dgRNA
  Pxdn
gctgcacctccgaga

SEQ ID NO: 76341 - DNA, 15 bp, Artificial Sequence
  dgRNA
  Pxdn
ctgcacctccgagaa

SEQ ID NO: 76342 - DNA, 15 bp, Artificial Sequence
  dgRNA
  Pxdn
ccgagaagggtcgct

SEQ ID NO: 76343 - DNA, 15 bp, Artificial Sequence
  dgRNA
  Pxdn
taggttcagacacca

SEQ ID NO: 76344 - DNA, 15 bp, Artificial Sequence
  dgRNA
  Tyw1
gaccgcgtttcccac

SEQ ID NO: 76345 - DNA, 15 bp, Artificial Sequence
  dgRNA
  Tyw1
caatccgagaagtac

SEQ ID NO: 76346 - DNA, 15 bp, Artificial Sequence
  dgRNA
  Tyw1
ttgagcctatcagag

SEQ ID NO: 76347 - DNA, 15 bp, Artificial Sequence
  dgRNA
  Tyw1
aacgcggtccagagc

SEQ ID NO: 76348 - DNA, 15 bp, Artificial Sequence
  dgRNA
  Olfr1104
tgctcttaatgctgg

SEQ ID NO: 76349 - DNA, 15 bp, Artificial Sequence
  dgRNA
  N4bp3
aacgagcacgcatcg

SEQ ID NO: 76350 - DNA, 15 bp, Artificial Sequence
  dgRNA
  N4bp3
gagcacgcatcgcgg

SEQ ID NO: 76351 - DNA, 15 bp, Artificial Sequence
  dgRNA
  N4bp3
ccgctgcaccatgcg

SEQ ID NO: 76352 - DNA, 15 bp, Artificial Sequence
  dgRNA
  N4bp3
accatgcgcggctag

SEQ ID NO: 76353 - DNA, 15 bp, Artificial Sequence
  dgRNA
  Ttf1
ggttgcttaattaga

SEQ ID NO: 76354 - DNA, 15 bp, Artificial Sequence
  dgRNA
  Ttf1
gttgcttaattagaa

SEQ ID NO: 76355 - DNA, 15 bp, Artificial Sequence
  dgRNA
  Ttf1
gcctccatgttacta

SEQ ID NO: 76356 - DNA, 15 bp, Artificial Sequence
  dgRNA
  Ttf1
agccggatgcgcagc

SEQ ID NO: 76357 - DNA, 15 bp, Artificial Sequence
  dgRNA
  Gpr20
gacaacccatagcct

SEQ ID NO: 76358 - DNA, 15 bp, Artificial Sequence
  dgRNA
  Gpr20
acaacccatagcctt

SEQ ID NO: 76359 - DNA, 15 bp, Artificial Sequence
  dgRNA
  Gpr20
tggtccgaacagctg

SEQ ID NO: 76360 - DNA, 15 bp, Artificial Sequence
  dgRNA
  Gpr20
tcacccctctgtcta

SEQ ID NO: 76361 - DNA, 15 bp, Artificial Sequence
  dgRNA
  Chgb
ctgaataagtacgtc

SEQ ID NO: 76362 - DNA, 15 bp, Artificial Sequence
  dgRNA
  Chgb
ataagtacgtcgggt

SEQ ID NO: 76363 - DNA, 15 bp, Artificial Sequence
  dgRNA
  Chgb
agaagtgccatagat

SEQ ID NO: 76364 - DNA, 15 bp, Artificial Sequence
  dgRNA
  Chgb
tgtgtatcccatcta

SEQ ID NO: 76365 - DNA, 15 bp, Artificial Sequence
  dgRNA
  Chac2
tttgcgccgcacatc

SEQ ID NO: 76366 - DNA, 15 bp, Artificial Sequence
  dgRNA
  Chac2
gcttcgcctgatgtg

SEQ ID NO: 76367 - DNA, 15 bp, Artificial Sequence
  dgRNA
  Slc2a2
tctgccacacttatc

SEQ ID NO: 76368 - DNA, 15 bp, Artificial Sequence
  dgRNA
  Slc2a2
aaagggtgtattgat

SEQ ID NO: 76369 - DNA, 15 bp, Artificial Sequence
  dgRNA
  Slc2a2
tcagcctgataagtg

SEQ ID NO: 76370 - DNA, 15 bp, Artificial Sequence
  dgRNA
  Slc2a2
taccccaatgacttg

SEQ ID NO: 76371 - DNA, 15 bp, Artificial Sequence
  dgRNA
  Pirt
agtgcctgcgccagc

SEQ ID NO: 76372 - DNA, 15 bp, Artificial Sequence
  dgRNA
  Pirt
cattaggccacatcc

SEQ ID NO: 76373 - DNA, 15 bp, Artificial Sequence
  dgRNA
  Pirt
tggctggtagtgcct

SEQ ID NO: 76374 - DNA, 15 bp, Artificial Sequence
  dgRNA
  Pirt
gcaggcactcgaatg

SEQ ID NO: 76375 - DNA, 15 bp, Artificial Sequence
  dgRNA
  Fam3a
acctcaaagtctaga

SEQ ID NO: 76376 - DNA, 15 bp, Artificial Sequence
  dgRNA
  Fam3a
gggaggtgccgagtg

SEQ ID NO: 76377 - DNA, 15 bp, Artificial Sequence
  dgRNA
  Olfr251
ccaagtttagtaagc

SEQ ID NO: 76378 - DNA, 15 bp, Artificial Sequence
  dgRNA
  Olfr251
cctgcttactaaact

SEQ ID NO: 76379 - DNA, 15 bp, Artificial Sequence
  dgRNA
  C87436
tgtactagggaccac

SEQ ID NO: 76380 - DNA, 15 bp, Artificial Sequence
  dgRNA
  C87436
gtactagggaccacc

SEQ ID NO: 76381 - DNA, 15 bp, Artificial Sequence
  dgRNA
  C87436
gtgccacttcagcgg

SEQ ID NO: 76382 - DNA, 15 bp, Artificial Sequence
  dgRNA
  C87436
ttcagcggaggtgag

SEQ ID NO: 76383 - DNA, 15 bp, Artificial Sequence
  dgRNA
  Rpp40
ttagggcgtggtgga

SEQ ID NO: 76384 - DNA, 15 bp, Artificial Sequence
  dgRNA
  Rpp40
tcagaaaggggcgaa

SEQ ID NO: 76385 - DNA, 15 bp, Artificial Sequence
  dgRNA
  Rpp40
gaaaggggcgaatgg

SEQ ID NO: 76386 - DNA, 15 bp, Artificial Sequence
  dgRNA
  Rpp40
aaaggggcgaatggt

SEQ ID NO: 76387 - DNA, 15 bp, Artificial Sequence
  dgRNA
  Spink10
gaagaagtgtcatcg

SEQ ID NO: 76388 - DNA, 15 bp, Artificial Sequence
  dgRNA
  Spink10
aagaagtgtcatcga

SEQ ID NO: 76389 - DNA, 15 bp, Artificial Sequence
  dgRNA
  Spink10
agtgtcatcgaggga

SEQ ID NO: 76390 - DNA, 15 bp, Artificial Sequence
  dgRNA
  Spink10
gtgtcatcgagggat

SEQ ID NO: 76391 - DNA, 15 bp, Artificial Sequence
  dgRNA
  Vsx1
ctggccagtgtagtc

SEQ ID NO: 76392 - DNA, 15 bp, Artificial Sequence
  dgRNA
  Vsx1
gtccctagatcttac

SEQ ID NO: 76393 - DNA, 15 bp, Artificial Sequence
  dgRNA
  Vsx1
atcttacaggttagt

SEQ ID NO: 76394 - DNA, 15 bp, Artificial Sequence
  dgRNA
  Vsx1
tatttaacccaccgc

SEQ ID NO: 76395 - DNA, 15 bp, Artificial Sequence
  dgRNA
  Gpr88
gttatccatcaccca

SEQ ID NO: 76396 - DNA, 15 bp, Artificial Sequence
  dgRNA
  Sash1
tccagtagaggcgag

SEQ ID NO: 76397 - DNA, 15 bp, Artificial Sequence
  dgRNA
  Sash1
gagtggtgtgccacc

SEQ ID NO: 76398 - DNA, 15 bp, Artificial Sequence
  dgRNA
  Sash1
tgtgccacccggagc

SEQ ID NO: 76399 - DNA, 15 bp, Artificial Sequence
  dgRNA
  Sash1
gccggtccccgaagc

SEQ ID NO: 76400 - DNA, 15 bp, Artificial Sequence
  dgRNA
  Hprt
gtcagataagagttc

SEQ ID NO: 76401 - DNA, 15 bp, Artificial Sequence
  dgRNA
  Hprt
ttccggaactgcctt

SEQ ID NO: 76402 - DNA, 15 bp, Artificial Sequence
  dgRNA
  Hprt
cggaactgcctttgg

SEQ ID NO: 76403 - DNA, 15 bp, Artificial Sequence
  dgRNA
  Hprt
ttggtggcgcgcgcg

SEQ ID NO: 76404 - DNA, 15 bp, Artificial Sequence
  dgRNA
  Zscan29
agcatattgaaagtc

SEQ ID NO: 76405 - DNA, 15 bp, Artificial Sequence
  dgRNA
  Zscan29
aggccggctctgaca

SEQ ID NO: 76406 - DNA, 15 bp, Artificial Sequence
  dgRNA
  Zscan29
gtttagagtatcccc

SEQ ID NO: 76407 - DNA, 15 bp, Artificial Sequence
  dgRNA
  Zscan29
gcaaatcaataggca

SEQ ID NO: 76408 - DNA, 15 bp, Artificial Sequence
  dgRNA
  Dytn
gctccctaagctcta

SEQ ID NO: 76409 - DNA, 15 bp, Artificial Sequence
  dgRNA
  Dytn
aaactaatacggaaa

SEQ ID NO: 76410 - DNA, 15 bp, Artificial Sequence
  dgRNA
  Dytn
tcatattatgactaa

SEQ ID NO: 76411 - DNA, 15 bp, Artificial Sequence
  dgRNA
  Dytn
tcaccatagagctta

SEQ ID NO: 76412 - DNA, 15 bp, Artificial Sequence
  dgRNA
  Zbtb38
aaccctgttaccaga

SEQ ID NO: 76413 - DNA, 15 bp, Artificial Sequence
  dgRNA
  Zbtb38
acatgtttattacgc

SEQ ID NO: 76414 - DNA, 15 bp, Artificial Sequence
  dgRNA
  Zbtb38
gtttattacgcaggt

SEQ ID NO: 76415 - DNA, 15 bp, Artificial Sequence
  dgRNA
  Zbtb38
tattacgcaggtagg

SEQ ID NO: 76416 - DNA, 15 bp, Artificial Sequence
  dgRNA
  4931409K22Rik
agaacgtaggcacaa

SEQ ID NO: 76417 - DNA, 15 bp, Artificial Sequence
  dgRNA
  4931409K22Rik
gaacgtaggcacaat

SEQ ID NO: 76418 - DNA, 15 bp, Artificial Sequence
  dgRNA
  4931409K22Rik
gtaggcacaatgggt

SEQ ID NO: 76419 - DNA, 15 bp, Artificial Sequence
  dgRNA
  4931409K22Rik
ttgcttaacttctgg

SEQ ID NO: 76420 - DNA, 15 bp, Artificial Sequence
  dgRNA
  Arhgap32
cacctgccactggta

SEQ ID NO: 76421 - DNA, 15 bp, Artificial Sequence
  dgRNA
  Arhgap32
acatcccatgccttg

SEQ ID NO: 76422 - DNA, 15 bp, Artificial Sequence
  dgRNA
  Arhgap32
tgccataccagtggc

SEQ ID NO: 76423 - DNA, 15 bp, Artificial Sequence
  dgRNA
  Arhgap32
gcacggtgtccaggt

SEQ ID NO: 76424 - DNA, 15 bp, Artificial Sequence
  dgRNA
  Olfr571
tgagtctgtgcctaa

SEQ ID NO: 76425 - DNA, 15 bp, Artificial Sequence
  dgRNA
  Apoe
atgcaccagaccccg

SEQ ID NO: 76426 - DNA, 15 bp, Artificial Sequence
  dgRNA
  Apoe
tgcaccagaccccgc

SEQ ID NO: 76427 - DNA, 15 bp, Artificial Sequence
  dgRNA
  Apoe
gcaccagaccccgcg

SEQ ID NO: 76428 - DNA, 15 bp, Artificial Sequence
  dgRNA
  Apoe
agaccccgcggggaa

SEQ ID NO: 76429 - DNA, 15 bp, Artificial Sequence
  dgRNA
  Bcl7b
ttgtgaattcgaggt

SEQ ID NO: 76430 - DNA, 15 bp, Artificial Sequence
  dgRNA
  Bcl7b
gtattgaaaattccc

SEQ ID NO: 76431 - DNA, 15 bp, Artificial Sequence
  dgRNA
  Bcl7b
cctcgcagcctcgcc

SEQ ID NO: 76432 - DNA, 15 bp, Artificial Sequence
  dgRNA
  Bcl7b
ggcccacaccacgtg

SEQ ID NO: 76433 - DNA, 15 bp, Artificial Sequence
  dgRNA
  Lclat1
tacccctaccagctt

SEQ ID NO: 76434 - DNA, 15 bp, Artificial Sequence
  dgRNA
  Lclat1
cctaccagctttggc

SEQ ID NO: 76435 - DNA, 15 bp, Artificial Sequence
  dgRNA
  Lclat1
gcaggcatctgcgcc

SEQ ID NO: 76436 - DNA, 15 bp, Artificial Sequence
  dgRNA
  Lclat1
cactgatctggggcg

SEQ ID NO: 76437 - DNA, 15 bp, Artificial Sequence
  dgRNA
  Barx2
gactcggaaaagtgg

SEQ ID NO: 76438 - DNA, 15 bp, Artificial Sequence
  dgRNA
  Barx2
acccgtacacacacc

SEQ ID NO: 76439 - DNA, 15 bp, Artificial Sequence
  dgRNA
  Barx2
taaaatagagccgcc

SEQ ID NO: 76440 - DNA, 15 bp, Artificial Sequence
  dgRNA
  Barx2
aaaatagagccgcct

SEQ ID NO: 76441 - DNA, 15 bp, Artificial Sequence
  dgRNA
  Tmem237
cggagtgtggcgaag

SEQ ID NO: 76442 - DNA, 15 bp, Artificial Sequence
  dgRNA
  Tmem237
agtgtggcgaagtgg

SEQ ID NO: 76443 - DNA, 15 bp, Artificial Sequence
  dgRNA
  Tmem237
tgaccaccgccgagc

SEQ ID NO: 76444 - DNA, 15 bp, Artificial Sequence
  dgRNA
  Tmem237
gaccaccgccgagcc

SEQ ID NO: 76445 - DNA, 15 bp, Artificial Sequence
  dgRNA
  Ufsp1
agtctgtgcaacacg

SEQ ID NO: 76446 - DNA, 15 bp, Artificial Sequence
  dgRNA
  Ufsp1
gtctgtgcaacacgc

SEQ ID NO: 76447 - DNA, 15 bp, Artificial Sequence
  dgRNA
  Ufsp1
caacacgcgggaagt

SEQ ID NO: 76448 - DNA, 15 bp, Artificial Sequence
  dgRNA
  Ufsp1
aacacgcgggaagtt

SEQ ID NO: 76449 - DNA, 15 bp, Artificial Sequence
  dgRNA
  Orm3
acatttatcaagtgc

SEQ ID NO: 76450 - DNA, 15 bp, Artificial Sequence
  dgRNA
  Scel
gttgaaagagcgata

SEQ ID NO: 76451 - DNA, 15 bp, Artificial Sequence
  dgRNA
  Scel
agctggtatttgtac

SEQ ID NO: 76452 - DNA, 15 bp, Artificial Sequence
  dgRNA
  Scel
acaatactggcaagc

SEQ ID NO: 76453 - DNA, 15 bp, Artificial Sequence
  dgRNA
  Scel
atcaacgcacaatac

SEQ ID NO: 76454 - DNA, 15 bp, Artificial Sequence
  dgRNA
  Pik3r2
tccgacggccgtgct

SEQ ID NO: 76455 - DNA, 15 bp, Artificial Sequence
  dgRNA
  Pik3r2
gcctcggctgtctcg

SEQ ID NO: 76456 - DNA, 15 bp, Artificial Sequence
  dgRNA
  Pik3r2
agcctcccattcccg

SEQ ID NO: 76457 - DNA, 15 bp, Artificial Sequence
  dgRNA
  Pik3r2
gcctcccattcccgc

SEQ ID NO: 76458 - DNA, 15 bp, Artificial Sequence
  dgRNA
  Tmsb10
cgcggggtgagcagc

SEQ ID NO: 76459 - DNA, 15 bp, Artificial Sequence
  dgRNA
  Tmsb10
gagaccaccgggagc

SEQ ID NO: 76460 - DNA, 15 bp, Artificial Sequence
  dgRNA
  Tmsb10
tgccaccctccacgc

SEQ ID NO: 76461 - DNA, 15 bp, Artificial Sequence
  dgRNA
  Tmsb10
cacgcgggatcgcaa

SEQ ID NO: 76462 - DNA, 15 bp, Artificial Sequence
  dgRNA
  Lamp3
tttccctgccataag

SEQ ID NO: 76463 - DNA, 15 bp, Artificial Sequence
  dgRNA
  Lamp3
gctagttagggtgaa

SEQ ID NO: 76464 - DNA, 15 bp, Artificial Sequence
  dgRNA
  Lamp3
ggctagttagggtga

SEQ ID NO: 76465 - DNA, 15 bp, Artificial Sequence
  dgRNA
  Lamp3
ggtgggggctagtta

SEQ ID NO: 76466 - DNA, 15 bp, Artificial Sequence
  dgRNA
  Srr
ctcgcagttccgatg

SEQ ID NO: 76467 - DNA, 15 bp, Artificial Sequence
  dgRNA
  Srr
cctccgccatcttcg

SEQ ID NO: 76468 - DNA, 15 bp, Artificial Sequence
  dgRNA
  Srr
ccgccatcttcgcgg

SEQ ID NO: 76469 - DNA, 15 bp, Artificial Sequence
  dgRNA
  Srr
cggctgctacagctg

SEQ ID NO: 76470 - DNA, 15 bp, Artificial Sequence
  dgRNA
  Lag3
tgaagagggggcggt

SEQ ID NO: 76471 - DNA, 15 bp, Artificial Sequence
  dgRNA
  Lag3
gccaccaccgagagg

SEQ ID NO: 76472 - DNA, 15 bp, Artificial Sequence
  dgRNA
  Lag3
accgagaggagggct

SEQ ID NO: 76473 - DNA, 15 bp, Artificial Sequence
  dgRNA
  Lag3
cgaaaccccgcgcct

SEQ ID NO: 76474 - DNA, 15 bp, Artificial Sequence
  dgRNA
  Mag
ccagccctagcccga

SEQ ID NO: 76475 - DNA, 15 bp, Artificial Sequence
  dgRNA
  Mag
agcccgatggtgaca

SEQ ID NO: 76476 - DNA, 15 bp, Artificial Sequence
  dgRNA
  Mag
gcccgatggtgacaa

SEQ ID NO: 76477 - DNA, 15 bp, Artificial Sequence
  dgRNA
  Mag
cctcccccgggggca

SEQ ID NO: 76478 - DNA, 15 bp, Artificial Sequence
  dgRNA
  Colgalt1
accgcgtgagattag

SEQ ID NO: 76479 - DNA, 15 bp, Artificial Sequence
  dgRNA
  Colgalt1
ccgcgtgagattaga

SEQ ID NO: 76480 - DNA, 15 bp, Artificial Sequence
  dgRNA
  Colgalt1
aacactctcagggcg

SEQ ID NO: 76481 - DNA, 15 bp, Artificial Sequence
  dgRNA
  Colgalt1
tttaaagctcgagct

SEQ ID NO: 76482 - DNA, 15 bp, Artificial Sequence
  dgRNA
  Fam92a
cggttgctggtgggt

SEQ ID NO: 76483 - DNA, 15 bp, Artificial Sequence
  dgRNA
  Fam92a
caacccaccagcaac

SEQ ID NO: 76484 - DNA, 15 bp, Artificial Sequence
  dgRNA
  Car11
cggccctttctactg

SEQ ID NO: 76485 - DNA, 15 bp, Artificial Sequence
  dgRNA
  Car11
aagggccgcacccct

SEQ ID NO: 76486 - DNA, 15 bp, Artificial Sequence
  dgRNA
  Car11
aaagggccgcacccc

SEQ ID NO: 76487 - DNA, 15 bp, Artificial Sequence
  dgRNA
  Car11
tctccgcagtagaaa

SEQ ID NO: 76488 - DNA, 15 bp, Artificial Sequence
  dgRNA
  Lrrc52
caccaagccggcagc

SEQ ID NO: 76489 - DNA, 15 bp, Artificial Sequence
  dgRNA
  Lrrc52
accaagccggcagca

SEQ ID NO: 76490 - DNA, 15 bp, Artificial Sequence
  dgRNA
  Lrrc52
ggaagctcgcccact

SEQ ID NO: 76491 - DNA, 15 bp, Artificial Sequence
  dgRNA
  Lrrc52
cagtccgagtgctgt

SEQ ID NO: 76492 - DNA, 15 bp, Artificial Sequence
  dgRNA
  Ccdc86
ggctccgcctaccca

SEQ ID NO: 76493 - DNA, 15 bp, Artificial Sequence
  dgRNA
  Ccdc86
gctccgcctacccac

SEQ ID NO: 76494 - DNA, 15 bp, Artificial Sequence
  dgRNA
  Ccdc86
agtgcgcttcctgcc

SEQ ID NO: 76495 - DNA, 15 bp, Artificial Sequence
  dgRNA
  Ccdc86
gcttcctgcccggta

SEQ ID NO: 76496 - DNA, 15 bp, Artificial Sequence
  dgRNA
  1700067P10Rik
gccaaatgcagttac

SEQ ID NO: 76497 - DNA, 15 bp, Artificial Sequence
  dgRNA
  1700067P10Rik
agttactggactacc

SEQ ID NO: 76498 - DNA, 15 bp, Artificial Sequence
  dgRNA
  1700067P10Rik
ccagcgatgtaacac

SEQ ID NO: 76499 - DNA, 15 bp, Artificial Sequence
  dgRNA
  1700067P10Rik
cagcgatgtaacaca

SEQ ID NO: 76500 - DNA, 15 bp, Artificial Sequence
  dgRNA
  Cenpq
gggtgtttttgctag

SEQ ID NO: 76501 - DNA, 15 bp, Artificial Sequence
  dgRNA
  Cenpq
gaggttacttgttag

SEQ ID NO: 76502 - DNA, 15 bp, Artificial Sequence
  dgRNA
  Cenpq
gcacgcgcagagcag

SEQ ID NO: 76503 - DNA, 15 bp, Artificial Sequence
  dgRNA
  Dusp22
ccgcctttagggact

SEQ ID NO: 76504 - DNA, 15 bp, Artificial Sequence
  dgRNA
  Dusp22
cgcctttagggactt

SEQ ID NO: 76505 - DNA, 15 bp, Artificial Sequence
  dgRNA
  Dusp22
gcgtgcgcaaactgc

SEQ ID NO: 76506 - DNA, 15 bp, Artificial Sequence
  dgRNA
  Dusp22
cgtgcgcaaactgca

SEQ ID NO: 76507 - DNA, 15 bp, Artificial Sequence
  dgRNA
  Atp6ap2
actcttgactcctat

SEQ ID NO: 76508 - DNA, 15 bp, Artificial Sequence
  dgRNA
  Atp6ap2
ttgctgacgtcgacc

SEQ ID NO: 76509 - DNA, 15 bp, Artificial Sequence
  dgRNA
  Atp6ap2
gtctcgctcgtgtag

SEQ ID NO: 76510 - DNA, 15 bp, Artificial Sequence
  dgRNA
  Atp6ap2
gtgtagcggcgtagt

SEQ ID NO: 76511 - DNA, 15 bp, Artificial Sequence
  dgRNA
  Tapbp
atggggatcccaaat

SEQ ID NO: 76512 - DNA, 15 bp, Artificial Sequence
  dgRNA
  Tapbp
ggagccgcgtagtat

SEQ ID NO: 76513 - DNA, 15 bp, Artificial Sequence
  dgRNA
  Tapbp
atcgttaagactcaa

SEQ ID NO: 76514 - DNA, 15 bp, Artificial Sequence
  dgRNA
  Tapbp
ggcgtatccttcaag

SEQ ID NO: 76515 - DNA, 15 bp, Artificial Sequence
  dgRNA
  Ssxb5
tagatgatctcgggg

SEQ ID NO: 76516 - DNA, 15 bp, Artificial Sequence
  dgRNA
  Ssxb5
gatctcggggtggaa

SEQ ID NO: 76517 - DNA, 15 bp, Artificial Sequence
  dgRNA
  Ssxb5
catctatccttggtt

SEQ ID NO: 76518 - DNA, 15 bp, Artificial Sequence
  dgRNA
  Ssxb5
gagatcatctatcct

SEQ ID NO: 76519 - DNA, 15 bp, Artificial Sequence
  dgRNA
  Vmn2r4
atagtctaggataca

SEQ ID NO: 76520 - DNA, 15 bp, Artificial Sequence
  dgRNA
  Vmn2r4
tattctcaaccacca

SEQ ID NO: 76521 - DNA, 15 bp, Artificial Sequence
  dgRNA
  Mettl20
ggtgcgtaagccctt

SEQ ID NO: 76522 - DNA, 15 bp, Artificial Sequence
  dgRNA
  Mettl20
gtaagcccttcggtc

SEQ ID NO: 76523 - DNA, 15 bp, Artificial Sequence
  dgRNA
  Mettl20
taagcccttcggtcc

SEQ ID NO: 76524 - DNA, 15 bp, Artificial Sequence
  dgRNA
  Mettl20
gcccttcggtccggg

SEQ ID NO: 76525 - DNA, 15 bp, Artificial Sequence
  dgRNA
  Acsf3
agacttgcgagcaga

SEQ ID NO: 76526 - DNA, 15 bp, Artificial Sequence
  dgRNA
  Acsf3
agtatgcgaatgagc

SEQ ID NO: 76527 - DNA, 15 bp, Artificial Sequence
  dgRNA
  Acsf3
aggaacgttcgttcc

SEQ ID NO: 76528 - DNA, 15 bp, Artificial Sequence
  dgRNA
  Acsf3
cggaacgcatttctc

SEQ ID NO: 76529 - DNA, 15 bp, Artificial Sequence
  dgRNA
  11-Sep
cggctggaggcgcgc

SEQ ID NO: 76530 - DNA, 15 bp, Artificial Sequence
  dgRNA
  11-Sep
gaggcgcgcgggagc

SEQ ID NO: 76531 - DNA, 15 bp, Artificial Sequence
  dgRNA
  11-Sep
aggcgcgcgggagcc

SEQ ID NO: 76532 - DNA, 15 bp, Artificial Sequence
  dgRNA
  11-Sep
gagccgggcgcgagc

SEQ ID NO: 76533 - DNA, 15 bp, Artificial Sequence
  dgRNA
  Cbx1
tacaatccttgaaag

SEQ ID NO: 76534 - DNA, 15 bp, Artificial Sequence
  dgRNA
  Cbx1
ggcgcgggattcgcg

SEQ ID NO: 76535 - DNA, 15 bp, Artificial Sequence
  dgRNA
  Cbx1
attcgcgcggtactt

SEQ ID NO: 76536 - DNA, 15 bp, Artificial Sequence
  dgRNA
  Cbx1
ttcgcgcggtacttt

SEQ ID NO: 76537 - DNA, 15 bp, Artificial Sequence
  dgRNA
  Acrv1
aatgctcttcactag

SEQ ID NO: 76538 - DNA, 15 bp, Artificial Sequence
  dgRNA
  Acrv1
ctagtggcattgcca

SEQ ID NO: 76539 - DNA, 15 bp, Artificial Sequence
  dgRNA
  Acrv1
tgaacaggatgtaag

SEQ ID NO: 76540 - DNA, 15 bp, Artificial Sequence
  dgRNA
  Acrv1
agaatagtgtgttag

SEQ ID NO: 76541 - DNA, 15 bp, Artificial Sequence
  dgRNA
  B4galt6
tcgtccccctccaaa

SEQ ID NO: 76542 - DNA, 15 bp, Artificial Sequence
  dgRNA
  B4galt6
cccatgctgaggacg

SEQ ID NO: 76543 - DNA, 15 bp, Artificial Sequence
  dgRNA
  B4galt6
gtgaccgggagggcg

SEQ ID NO: 76544 - DNA, 15 bp, Artificial Sequence
  dgRNA
  B4galt6
agggcggggcgacgt

SEQ ID NO: 76545 - DNA, 15 bp, Artificial Sequence
  dgRNA
  Nxnl1
caggaggatctaacc

SEQ ID NO: 76546 - DNA, 15 bp, Artificial Sequence
  dgRNA
  Nxnl1
ctaaccaggctaatc

SEQ ID NO: 76547 - DNA, 15 bp, Artificial Sequence
  dgRNA
  Nxnl1
tgagggtattattct

SEQ ID NO: 76548 - DNA, 15 bp, Artificial Sequence
  dgRNA
  Nxnl1
gagggtattattctt

SEQ ID NO: 76549 - DNA, 15 bp, Artificial Sequence
  dgRNA
  Fbxl18
agtgtgtagcgcgaa

SEQ ID NO: 76550 - DNA, 15 bp, Artificial Sequence
  dgRNA
  Fbxl18
cagaacgcatgttgt

SEQ ID NO: 76551 - DNA, 15 bp, Artificial Sequence
  dgRNA
  Fbxl18
ggtagcttaagagac

SEQ ID NO: 76552 - DNA, 15 bp, Artificial Sequence
  dgRNA
  Fbxl18
tcactcgtgaccttc

SEQ ID NO: 76553 - DNA, 15 bp, Artificial Sequence
  dgRNA
  Xkr7
ggcgggggcagtcaa

SEQ ID NO: 76554 - DNA, 15 bp, Artificial Sequence
  dgRNA
  Xkr7
gcgggggcagtcaaa

SEQ ID NO: 76555 - DNA, 15 bp, Artificial Sequence
  dgRNA
  Xkr7
cgggggcagtcaaag

SEQ ID NO: 76556 - DNA, 15 bp, Artificial Sequence
  dgRNA
  Xkr7
ggccccacgcctccg

SEQ ID NO: 76557 - DNA, 15 bp, Artificial Sequence
  dgRNA
  Nap1l4
taacggcgcggcggg

SEQ ID NO: 76558 - DNA, 15 bp, Artificial Sequence
  dgRNA
  Nap1l4
cggctggcgagggac

SEQ ID NO: 76559 - DNA, 15 bp, Artificial Sequence
  dgRNA
  Nap1l4
caggccgacgcgcca

SEQ ID NO: 76560 - DNA, 15 bp, Artificial Sequence
  dgRNA
  Nap1l4
gccgacgcgccatgg

SEQ ID NO: 76561 - DNA, 15 bp, Artificial Sequence
  dgRNA
  Gm10228
ctttgtttgccaatt

SEQ ID NO: 76562 - DNA, 15 bp, Artificial Sequence
  dgRNA
  Gm10228
acctcaaagttatta

SEQ ID NO: 76563 - DNA, 15 bp, Artificial Sequence
  dgRNA
  Esp6
ccgagaagttactca

SEQ ID NO: 76564 - DNA, 15 bp, Artificial Sequence
  dgRNA
  Esp6
atcaatctactcttc

SEQ ID NO: 76565 - DNA, 15 bp, Artificial Sequence
  dgRNA
  Esp6
aagcacaaacacgtc

SEQ ID NO: 76566 - DNA, 15 bp, Artificial Sequence
  dgRNA
  Esp6
cctctacccatttaa

SEQ ID NO: 76567 - DNA, 15 bp, Artificial Sequence
  dgRNA
  Dram2
cggagcgagggccgg

SEQ ID NO: 76568 - DNA, 15 bp, Artificial Sequence
  dgRNA
  Dram2
cggttttgtcccggg

SEQ ID NO: 76569 - DNA, 15 bp, Artificial Sequence
  dgRNA
  Dram2
ggggcggttttgtcc

SEQ ID NO: 76570 - DNA, 15 bp, Artificial Sequence
  dgRNA
  Tpsb2
aagcccgcagactcc

SEQ ID NO: 76571 - DNA, 15 bp, Artificial Sequence
  dgRNA
  Tpsb2
agcccgcagactcct

SEQ ID NO: 76572 - DNA, 15 bp, Artificial Sequence
  dgRNA
  Tpsb2
tgacatatagacacc

SEQ ID NO: 76573 - DNA, 15 bp, Artificial Sequence
  dgRNA
  Tpsb2
tgcaccaggttacaa

SEQ ID NO: 76574 - DNA, 15 bp, Artificial Sequence
  dgRNA
  Ap2a2
tactccggtatacat

SEQ ID NO: 76575 - DNA, 15 bp, Artificial Sequence
  dgRNA
  Ap2a2
ccggtatacattgga

SEQ ID NO: 76576 - DNA, 15 bp, Artificial Sequence
  dgRNA
  Ap2a2
gaaggatccttcacc

SEQ ID NO: 76577 - DNA, 15 bp, Artificial Sequence
  dgRNA
  Ap2a2
ggatccttcaccagg

SEQ ID NO: 76578 - DNA, 15 bp, Artificial Sequence
  dgRNA
  Ceacam15
caactcttcttggtg

SEQ ID NO: 76579 - DNA, 15 bp, Artificial Sequence
  dgRNA
  Aldh9a1
cttcgggatctggac

SEQ ID NO: 76580 - DNA, 15 bp, Artificial Sequence
  dgRNA
  Aldh9a1
cgggatctggaccgg

SEQ ID NO: 76581 - DNA, 15 bp, Artificial Sequence
  dgRNA
  Aldh9a1
ctggaccggaggact

SEQ ID NO: 76582 - DNA, 15 bp, Artificial Sequence
  dgRNA
  Aldh9a1
tggaccggaggactt

SEQ ID NO: 76583 - DNA, 15 bp, Artificial Sequence
  dgRNA
  Lsp1
gccaagatggtctga

SEQ ID NO: 76584 - DNA, 15 bp, Artificial Sequence
  dgRNA
  Lsp1
atgctgcccacaagc

SEQ ID NO: 76585 - DNA, 15 bp, Artificial Sequence
  dgRNA
  Lsp1
gcccacaagcgggcg

SEQ ID NO: 76586 - DNA, 15 bp, Artificial Sequence
  dgRNA
  Lsp1
cacaagcgggcgtgg

SEQ ID NO: 76587 - DNA, 15 bp, Artificial Sequence
  dgRNA
  Pdxdc1
gccccgcccacccga

SEQ ID NO: 76588 - DNA, 15 bp, Artificial Sequence
  dgRNA
  Pdxdc1
ccccgcccacccgac

SEQ ID NO: 76589 - DNA, 15 bp, Artificial Sequence
  dgRNA
  Pdxdc1
ccttcagcaagccgc

SEQ ID NO: 76590 - DNA, 15 bp, Artificial Sequence
  dgRNA
  Pdxdc1
gccgcaggatacctg

SEQ ID NO: 76591 - DNA, 15 bp, Artificial Sequence
  dgRNA
  Trim52
ataccattaagacgg

SEQ ID NO: 76592 - DNA, 15 bp, Artificial Sequence
  dgRNA
  Trim52
gacggaggtcctcca

SEQ ID NO: 76593 - DNA, 15 bp, Artificial Sequence
  dgRNA
  Trim52
acggaggtcctccaa

SEQ ID NO: 76594 - DNA, 15 bp, Artificial Sequence
  dgRNA
  Trim52
cggaggtcctccaag

SEQ ID NO: 76595 - DNA, 15 bp, Artificial Sequence
  dgRNA
  Igsf9
ccgccccctattgtg

SEQ ID NO: 76596 - DNA, 15 bp, Artificial Sequence
  dgRNA
  Igsf9
aaatggggtgccagc

SEQ ID NO: 76597 - DNA, 15 bp, Artificial Sequence
  dgRNA
  Igsf9
aatggggtgccagcg

SEQ ID NO: 76598 - DNA, 15 bp, Artificial Sequence
  dgRNA
  Igsf9
gcagccacacaatag

SEQ ID NO: 76599 - DNA, 15 bp, Artificial Sequence
  dgRNA
  Shox2
gggcgctctcccgtc

SEQ ID NO: 76600 - DNA, 15 bp, Artificial Sequence
  dgRNA
  Shox2
ctcccgtccgggagc

SEQ ID NO: 76601 - DNA, 15 bp, Artificial Sequence
  dgRNA
  Shox2
tggacatgggagccg

SEQ ID NO: 76602 - DNA, 15 bp, Artificial Sequence
  dgRNA
  Shox2
gccgcggagcggagc

SEQ ID NO: 76603 - DNA, 15 bp, Artificial Sequence
  dgRNA
  Stk24
tctcttccgcgcgcg

SEQ ID NO: 76604 - DNA, 15 bp, Artificial Sequence
  dgRNA
  Stk24
gcgaggcccaccccg

SEQ ID NO: 76605 - DNA, 15 bp, Artificial Sequence
  dgRNA
  Stk24
accccgcggttccga

SEQ ID NO: 76606 - DNA, 15 bp, Artificial Sequence
  dgRNA
  Stk24
ggttccgaaggaccc

SEQ ID NO: 76607 - DNA, 15 bp, Artificial Sequence
  dgRNA
  Map1lc3a
tgctaaactcgatga

SEQ ID NO: 76608 - DNA, 15 bp, Artificial Sequence
  dgRNA
  Map1lc3a
aactcgatgaaggtg

SEQ ID NO: 76609 - DNA, 15 bp, Artificial Sequence
  dgRNA
  Map1lc3a
gcagcgtcgagagac

SEQ ID NO: 76610 - DNA, 15 bp, Artificial Sequence
  dgRNA
  Map1lc3a
cgtcgagagactgga

SEQ ID NO: 76611 - DNA, 15 bp, Artificial Sequence
  dgRNA
  Psmb9
agattcccgggagca

SEQ ID NO: 76612 - DNA, 15 bp, Artificial Sequence
  dgRNA
  Psmb9
gattcccgggagcat

SEQ ID NO: 76613 - DNA, 15 bp, Artificial Sequence
  dgRNA
  Psmb9
tccaccagaaggagc

SEQ ID NO: 76614 - DNA, 15 bp, Artificial Sequence
  dgRNA
  Psmb9
agtctggtcctagcc

SEQ ID NO: 76615 - DNA, 15 bp, Artificial Sequence
  dgRNA
  Fam50b
tcagacgctggcagc

SEQ ID NO: 76616 - DNA, 15 bp, Artificial Sequence
  dgRNA
  Fam50b
tcagtcagtccaagt

SEQ ID NO: 76617 - DNA, 15 bp, Artificial Sequence
  dgRNA
  Fam50b
tgaccaccacctgat

SEQ ID NO: 76618 - DNA, 15 bp, Artificial Sequence
  dgRNA
  Fam50b
gcctgccctagcagt

SEQ ID NO: 76619 - DNA, 15 bp, Artificial Sequence
  dgRNA
  Pnpla1
gggggcgtggcggat

SEQ ID NO: 76620 - DNA, 15 bp, Artificial Sequence
  dgRNA
  Pnpla1
ggggcgtggcggata

SEQ ID NO: 76621 - DNA, 15 bp, Artificial Sequence
  dgRNA
  Pnpla1
gggcgtggcggatag

SEQ ID NO: 76622 - DNA, 15 bp, Artificial Sequence
  dgRNA
  Pnpla1
ggcgtggcggatagg

SEQ ID NO: 76623 - DNA, 15 bp, Artificial Sequence
  dgRNA
  Mier2
tgattggctgatgta

SEQ ID NO: 76624 - DNA, 15 bp, Artificial Sequence
  dgRNA
  Mier2
gattggctgatgtac

SEQ ID NO: 76625 - DNA, 15 bp, Artificial Sequence
  dgRNA
  Mier2
gctgatgtacgggcg

SEQ ID NO: 76626 - DNA, 15 bp, Artificial Sequence
  dgRNA
  Mier2
ctgatgtacgggcgt

SEQ ID NO: 76627 - DNA, 15 bp, Artificial Sequence
  dgRNA
  Krtap5-4
ggggcagaattccct

SEQ ID NO: 76628 - DNA, 15 bp, Artificial Sequence
  dgRNA
  Krtap5-4
tgtggcggtttgctc

SEQ ID NO: 76629 - DNA, 15 bp, Artificial Sequence
  dgRNA
  Krtap5-4
ggtttgctcaggaat

SEQ ID NO: 76630 - DNA, 15 bp, Artificial Sequence
  dgRNA
  Krtap5-4
tcatgacacctgacc

SEQ ID NO: 76631 - DNA, 15 bp, Artificial Sequence
  dgRNA
  Hpx
ggtaggggttactgc

SEQ ID NO: 76632 - DNA, 15 bp, Artificial Sequence
  dgRNA
  Hpx
gtaggggttactgcc

SEQ ID NO: 76633 - DNA, 15 bp, Artificial Sequence
  dgRNA
  Hpx
gtcagtcttagattc

SEQ ID NO: 76634 - DNA, 15 bp, Artificial Sequence
  dgRNA
  Hpx
gtcatctgccaatat

SEQ ID NO: 76635 - DNA, 15 bp, Artificial Sequence
  dgRNA
  Kat8
ccgcccccactgatc

SEQ ID NO: 76636 - DNA, 15 bp, Artificial Sequence
  dgRNA
  Kat8
atccggaaataaaag

SEQ ID NO: 76637 - DNA, 15 bp, Artificial Sequence
  dgRNA
  Kat8
ataaaagcggctctc

SEQ ID NO: 76638 - DNA, 15 bp, Artificial Sequence
  dgRNA
  Kat8
ggcccaacttgagac

SEQ ID NO: 76639 - DNA, 15 bp, Artificial Sequence
  dgRNA
  Poldip2
gagcagcctcgagct

SEQ ID NO: 76640 - DNA, 15 bp, Artificial Sequence
  dgRNA
  Poldip2
tgggcacgcagcttc

SEQ ID NO: 76641 - DNA, 15 bp, Artificial Sequence
  dgRNA
  Poldip2
gggcacgcagcttcc

SEQ ID NO: 76642 - DNA, 15 bp, Artificial Sequence
  dgRNA
  Poldip2
ggcacgcagcttccg

SEQ ID NO: 76643 - DNA, 15 bp, Artificial Sequence
  dgRNA
  Lonp2
atctagctccagcgc

SEQ ID NO: 76644 - DNA, 15 bp, Artificial Sequence
  dgRNA
  Lonp2
cttcgtgcagtcacg

SEQ ID NO: 76645 - DNA, 15 bp, Artificial Sequence
  dgRNA
  Lonp2
cacgtggcacagttg

SEQ ID NO: 76646 - DNA, 15 bp, Artificial Sequence
  dgRNA
  Lonp2
gaagatgaccagcgc

SEQ ID NO: 76647 - DNA, 15 bp, Artificial Sequence
  dgRNA
  Fshr
tatccggacagtgtg

SEQ ID NO: 76648 - DNA, 15 bp, Artificial Sequence
  dgRNA
  Fshr
ccggacagtgtgtgg

SEQ ID NO: 76649 - DNA, 15 bp, Artificial Sequence
  dgRNA
  Fshr
ctggggaatccgtgg

SEQ ID NO: 76650 - DNA, 15 bp, Artificial Sequence
  dgRNA
  Fshr
ggaggttttcgctgc

SEQ ID NO: 76651 - DNA, 15 bp, Artificial Sequence
  dgRNA
  Tuba1b
cagggctcgcccaca

SEQ ID NO: 76652 - DNA, 15 bp, Artificial Sequence
  dgRNA
  Tuba1b
ggagcgattctcctc

SEQ ID NO: 76653 - DNA, 15 bp, Artificial Sequence
  dgRNA
  Tuba1b
gcatggcgcgcgccc

SEQ ID NO: 76654 - DNA, 15 bp, Artificial Sequence
  dgRNA
  Tuba1b
tggcgcgcgccccgg

SEQ ID NO: 76655 - DNA, 15 bp, Artificial Sequence
  dgRNA
  Ppic
ctctctgcgcgctgc

SEQ ID NO: 76656 - DNA, 15 bp, Artificial Sequence
  dgRNA
  Ppic
gctgcgggccctatt

SEQ ID NO: 76657 - DNA, 15 bp, Artificial Sequence
  dgRNA
  Ppic
ccccaattccggcca

SEQ ID NO: 76658 - DNA, 15 bp, Artificial Sequence
  dgRNA
  Ppic
ccacggttttgaact

SEQ ID NO: 76659 - DNA, 15 bp, Artificial Sequence
  dgRNA
  Med30
actggtaccgccccc

SEQ ID NO: 76660 - DNA, 15 bp, Artificial Sequence
  dgRNA
  Med30
ctggtaccgccccct

SEQ ID NO: 76661 - DNA, 15 bp, Artificial Sequence
  dgRNA
  Med30
actctacttctgatt

SEQ ID NO: 76662 - DNA, 15 bp, Artificial Sequence
  dgRNA
  Med30
taccgttcccaactg

SEQ ID NO: 76663 - DNA, 15 bp, Artificial Sequence
  dgRNA
  Lce1b
catggactatgattt

SEQ ID NO: 76664 - DNA, 15 bp, Artificial Sequence
  dgRNA
  Zscan2
atgattgaaggtatt

SEQ ID NO: 76665 - DNA, 15 bp, Artificial Sequence
  dgRNA
  Zscan2
tatataggggccttg

SEQ ID NO: 76666 - DNA, 15 bp, Artificial Sequence
  dgRNA
  Zscan2
gacttgtagtgaagc

SEQ ID NO: 76667 - DNA, 15 bp, Artificial Sequence
  dgRNA
  Zscan2
acttgtagtgaagct

SEQ ID NO: 76668 - DNA, 15 bp, Artificial Sequence
  dgRNA
  Ttc21a
gatcttccaccaccc

SEQ ID NO: 76669 - DNA, 15 bp, Artificial Sequence
  dgRNA
  Ttc21a
gccctcgccgcccgc

SEQ ID NO: 76670 - DNA, 15 bp, Artificial Sequence
  dgRNA
  Ttc21a
cgtggcctagtcacg

SEQ ID NO: 76671 - DNA, 15 bp, Artificial Sequence
  dgRNA
  Ttc21a
gtggcctagtcacgt

SEQ ID NO: 76672 - DNA, 15 bp, Artificial Sequence
  dgRNA
  Nfxl1
cggcacgcccaccaa

SEQ ID NO: 76673 - DNA, 15 bp, Artificial Sequence
  dgRNA
  Nfxl1
cacgcccaccaacgg

SEQ ID NO: 76674 - DNA, 15 bp, Artificial Sequence
  dgRNA
  Nfxl1
agcctcggaacactc

SEQ ID NO: 76675 - DNA, 15 bp, Artificial Sequence
  dgRNA
  Nfxl1
gcctcggaacactct

SEQ ID NO: 76676 - DNA, 15 bp, Artificial Sequence
  dgRNA
  Spen
actaagctgactgcg

SEQ ID NO: 76677 - DNA, 15 bp, Artificial Sequence
  dgRNA
  Spen
ctaagctgactgcgc

SEQ ID NO: 76678 - DNA, 15 bp, Artificial Sequence
  dgRNA
  Spen
gcgggcgccgcttcc

SEQ ID NO: 76679 - DNA, 15 bp, Artificial Sequence
  dgRNA
  Spen
cgcgcgcctgcgcgc

SEQ ID NO: 76680 - DNA, 15 bp, Artificial Sequence
  dgRNA
  Olfr141
tcctagactactgat

SEQ ID NO: 76681 - DNA, 15 bp, Artificial Sequence
  dgRNA
  Olfr141
acctatcagtagtct

SEQ ID NO: 76682 - DNA, 15 bp, Artificial Sequence
  dgRNA
  Olfr141
aagatacgcgggcta

SEQ ID NO: 76683 - DNA, 15 bp, Artificial Sequence
  dgRNA
  Olfr141
atgttgaagatacgc

SEQ ID NO: 76684 - DNA, 15 bp, Artificial Sequence
  dgRNA
  Lig4
ggaggcgcgctgcgc

SEQ ID NO: 76685 - DNA, 15 bp, Artificial Sequence
  dgRNA
  Lig4
tctgagccgccgcgc

SEQ ID NO: 76686 - DNA, 15 bp, Artificial Sequence
  dgRNA
  Lig4
cctttaaaagccggc

SEQ ID NO: 76687 - DNA, 15 bp, Artificial Sequence
  dgRNA
  Lig4
tgcgcggcaagcagc

SEQ ID NO: 76688 - DNA, 15 bp, Artificial Sequence
  dgRNA
  Gfm2
accggaactgcttag

SEQ ID NO: 76689 - DNA, 15 bp, Artificial Sequence
  dgRNA
  Gfm2
ccggaactgcttaga

SEQ ID NO: 76690 - DNA, 15 bp, Artificial Sequence
  dgRNA
  Gfm2
gaactgcttagaggg

SEQ ID NO: 76691 - DNA, 15 bp, Artificial Sequence
  dgRNA
  Gfm2
ggcggaaggtgctta

SEQ ID NO: 76692 - DNA, 15 bp, Artificial Sequence
  dgRNA
  Thbs4
tcattccattccgtc

SEQ ID NO: 76693 - DNA, 15 bp, Artificial Sequence
  dgRNA
  Thbs4
caccagcgtttccct

SEQ ID NO: 76694 - DNA, 15 bp, Artificial Sequence
  dgRNA
  Thbs4
cagcgtttccctcgg

SEQ ID NO: 76695 - DNA, 15 bp, Artificial Sequence
  dgRNA
  Thbs4
ggtggcccacgctcc

SEQ ID NO: 76696 - DNA, 15 bp, Artificial Sequence
  dgRNA
  Piwil1
aggaggattcgcacc

SEQ ID NO: 76697 - DNA, 15 bp, Artificial Sequence
  dgRNA
  Piwil1
ttcgcacctggagca

SEQ ID NO: 76698 - DNA, 15 bp, Artificial Sequence
  dgRNA
  Piwil1
aaaccgccacccacg

SEQ ID NO: 76699 - DNA, 15 bp, Artificial Sequence
  dgRNA
  Piwil1
acgtggcagccaatc

SEQ ID NO: 76700 - DNA, 15 bp, Artificial Sequence
  dgRNA
  Lat2
ccgaggcggatgtag

SEQ ID NO: 76701 - DNA, 15 bp, Artificial Sequence
  dgRNA
  Lat2
tgattcagtagtgac

SEQ ID NO: 76702 - DNA, 15 bp, Artificial Sequence
  dgRNA
  Lat2
cctctacatccgcct

SEQ ID NO: 76703 - DNA, 15 bp, Artificial Sequence
  dgRNA
  Cacna1c
ttgttggtacccaac

SEQ ID NO: 76704 - DNA, 15 bp, Artificial Sequence
  dgRNA
  Cacna1c
ctgtaaagtctcatg

SEQ ID NO: 76705 - DNA, 15 bp, Artificial Sequence
  dgRNA
  Apbb1ip
aattgtaaccaacgt

SEQ ID NO: 76706 - DNA, 15 bp, Artificial Sequence
  dgRNA
  Apbb1ip
atatttagatctcct

SEQ ID NO: 76707 - DNA, 15 bp, Artificial Sequence
  dgRNA
  Apbb1ip
gaactaactgcctgc

SEQ ID NO: 76708 - DNA, 15 bp, Artificial Sequence
  dgRNA
  Apbb1ip
gtgaactctcttgta

SEQ ID NO: 76709 - DNA, 15 bp, Artificial Sequence
  dgRNA
  Mrpl9
ccacgcaaagctctg

SEQ ID NO: 76710 - DNA, 15 bp, Artificial Sequence
  dgRNA
  Mrpl9
ccgctgtcctatcgt

SEQ ID NO: 76711 - DNA, 15 bp, Artificial Sequence
  dgRNA
  Mrpl9
tatcgtcggcgtgca

SEQ ID NO: 76712 - DNA, 15 bp, Artificial Sequence
  dgRNA
  Mrpl9
cgtcggcgtgcaagg

SEQ ID NO: 76713 - DNA, 15 bp, Artificial Sequence
  dgRNA
  Trim2
gatgccatgtttagg

SEQ ID NO: 76714 - DNA, 15 bp, Artificial Sequence
  dgRNA
  Trim2
tggacctatcagagg

SEQ ID NO: 76715 - DNA, 15 bp, Artificial Sequence
  dgRNA
  Trim2
cttcgtcaattttcc

SEQ ID NO: 76716 - DNA, 15 bp, Artificial Sequence
  dgRNA
  Trim2
agtgcctcctaaaca

SEQ ID NO: 76717 - DNA, 15 bp, Artificial Sequence
  dgRNA
  Fam234a
cgaaaagggcaacac

SEQ ID NO: 76718 - DNA, 15 bp, Artificial Sequence
  dgRNA
  l7Rn6
cggaagtactcgttc

SEQ ID NO: 76719 - DNA, 15 bp, Artificial Sequence
  dgRNA
  l7Rn6
gtactcgttccggag

SEQ ID NO: 76720 - DNA, 15 bp, Artificial Sequence
  dgRNA
  l7Rn6
agggtcagaggtcgc

SEQ ID NO: 76721 - DNA, 15 bp, Artificial Sequence
  dgRNA
  l7Rn6
gttgttatgtagtgg

SEQ ID NO: 76722 - DNA, 15 bp, Artificial Sequence
  dgRNA
  Pld6
gagcgcgcttcccca

SEQ ID NO: 76723 - DNA, 15 bp, Artificial Sequence
  dgRNA
  Pld6
agcgcgcttccccaa

SEQ ID NO: 76724 - DNA, 15 bp, Artificial Sequence
  dgRNA
  Pld6
gctctttgctagctt

SEQ ID NO: 76725 - DNA, 15 bp, Artificial Sequence
  dgRNA
  Pld6
cgctagtttagctcc

SEQ ID NO: 76726 - DNA, 15 bp, Artificial Sequence
  dgRNA
  Mansc4
tagctgactagctga

SEQ ID NO: 76727 - DNA, 15 bp, Artificial Sequence
  dgRNA
  Mansc4
gccagcactctcccg

SEQ ID NO: 76728 - DNA, 15 bp, Artificial Sequence
  dgRNA
  Mansc4
cctaggcaggcataa

SEQ ID NO: 76729 - DNA, 15 bp, Artificial Sequence
  dgRNA
  Wash1
aacagagcgggcgtt

SEQ ID NO: 76730 - DNA, 15 bp, Artificial Sequence
  dgRNA
  Nsmce4a
gatgcatgactaagt

SEQ ID NO: 76731 - DNA, 15 bp, Artificial Sequence
  dgRNA
  Nsmce4a
atgcatgactaagtg

SEQ ID NO: 76732 - DNA, 15 bp, Artificial Sequence
  dgRNA
  Nsmce4a
ctaagaaccaatgcg

SEQ ID NO: 76733 - DNA, 15 bp, Artificial Sequence
  dgRNA
  Nsmce4a
cgccgccgcgacctc

SEQ ID NO: 76734 - DNA, 15 bp, Artificial Sequence
  dgRNA
  Mapk14
caggaaacgttcctt

SEQ ID NO: 76735 - DNA, 15 bp, Artificial Sequence
  dgRNA
  Mapk14
ataccgactttatct

SEQ ID NO: 76736 - DNA, 15 bp, Artificial Sequence
  dgRNA
  Mapk14
accgactttatctcg

SEQ ID NO: 76737 - DNA, 15 bp, Artificial Sequence
  dgRNA
  Mapk14
ttatctcggggacca

SEQ ID NO: 76738 - DNA, 15 bp, Artificial Sequence
  dgRNA
  Krt222
tgtatcaacaacaat

SEQ ID NO: 76739 - DNA, 15 bp, Artificial Sequence
  dgRNA
  Krt222
caacaatgggcggga

SEQ ID NO: 76740 - DNA, 15 bp, Artificial Sequence
  dgRNA
  Krt222
aacaatgggcgggaa

SEQ ID NO: 76741 - DNA, 15 bp, Artificial Sequence
  dgRNA
  Krt222
attaattagcaaccc

SEQ ID NO: 76742 - DNA, 15 bp, Artificial Sequence
  dgRNA
  Cyp3a13
tgtaggtctgttcat

SEQ ID NO: 76743 - DNA, 15 bp, Artificial Sequence
  dgRNA
  Cyp3a13
gtacttaagttcttc

SEQ ID NO: 76744 - DNA, 15 bp, Artificial Sequence
  dgRNA
  Cyp3a13
tatcgaccaaaactg

SEQ ID NO: 76745 - DNA, 15 bp, Artificial Sequence
  dgRNA
  Cyp3a13
gttggcaaagaatca

SEQ ID NO: 76746 - DNA, 15 bp, Artificial Sequence
  dgRNA
  Hgh1
cacgcaataggcagc

SEQ ID NO: 76747 - DNA, 15 bp, Artificial Sequence
  dgRNA
  Hgh1
atctgcaccagctta

SEQ ID NO: 76748 - DNA, 15 bp, Artificial Sequence
  dgRNA
  Hgh1
tctgcaccagcttaa

SEQ ID NO: 76749 - DNA, 15 bp, Artificial Sequence
  dgRNA
  Hgh1
ctgcaccagcttaag

SEQ ID NO: 76750 - DNA, 15 bp, Artificial Sequence
  dgRNA
  Tspan15
ccccttcgcgtccat

SEQ ID NO: 76751 - DNA, 15 bp, Artificial Sequence
  dgRNA
  Tspan15
gcattgtccgctccc

SEQ ID NO: 76752 - DNA, 15 bp, Artificial Sequence
  dgRNA
  Tspan15
gctccctggcccgag

SEQ ID NO: 76753 - DNA, 15 bp, Artificial Sequence
  dgRNA
  Tspan15
cccgagcggtgattg

SEQ ID NO: 76754 - DNA, 15 bp, Artificial Sequence
  dgRNA
  Kif1b
gtgccggcggagcga

SEQ ID NO: 76755 - DNA, 15 bp, Artificial Sequence
  dgRNA
  Prss37
gatatcatcaccagc

SEQ ID NO: 76756 - DNA, 15 bp, Artificial Sequence
  dgRNA
  Inppl1
cgaaagcgagaagct

SEQ ID NO: 76757 - DNA, 15 bp, Artificial Sequence
  dgRNA
  Inppl1
cgcactgaagagcca

SEQ ID NO: 76758 - DNA, 15 bp, Artificial Sequence
  dgRNA
  Inppl1
ccgaggtcactctgc

SEQ ID NO: 76759 - DNA, 15 bp, Artificial Sequence
  dgRNA
  Inppl1
cactctgcgggcgtg

SEQ ID NO: 76760 - DNA, 15 bp, Artificial Sequence
  dgRNA
  Tas1r1
accacaagcgtccag

SEQ ID NO: 76761 - DNA, 15 bp, Artificial Sequence
  dgRNA
  Tas1r1
aagcgtccagaggat

SEQ ID NO: 76762 - DNA, 15 bp, Artificial Sequence
  dgRNA
  Tas1r1
agcgtccagaggatg

SEQ ID NO: 76763 - DNA, 15 bp, Artificial Sequence
  dgRNA
  Tas1r1
tttgaactaactcca

SEQ ID NO: 76764 - DNA, 15 bp, Artificial Sequence
  dgRNA
  Vkorc1
attggagaacgccag

SEQ ID NO: 76765 - DNA, 15 bp, Artificial Sequence
  dgRNA
  Vkorc1
ggagaacgccagcgg

SEQ ID NO: 76766 - DNA, 15 bp, Artificial Sequence
  dgRNA
  Vkorc1
ggccgaccaatcttc

SEQ ID NO: 76767 - DNA, 15 bp, Artificial Sequence
  dgRNA
  Vkorc1
gaccaatcttccggt

SEQ ID NO: 76768 - DNA, 15 bp, Artificial Sequence
  dgRNA
  Slamf7
cctaacagtcatacc

SEQ ID NO: 76769 - DNA, 15 bp, Artificial Sequence
  dgRNA
  Slamf7
tggcttcacatcgct

SEQ ID NO: 76770 - DNA, 15 bp, Artificial Sequence
  dgRNA
  Slamf7
gagtccaatcagagg

SEQ ID NO: 76771 - DNA, 15 bp, Artificial Sequence
  dgRNA
  Slamf7
gcagagtccaatcag

SEQ ID NO: 76772 - DNA, 15 bp, Artificial Sequence
  dgRNA
  Tgm5
ctccacggggatgga

SEQ ID NO: 76773 - DNA, 15 bp, Artificial Sequence
  dgRNA
  Tgm5
cctccacggggatgg

SEQ ID NO: 76774 - DNA, 15 bp, Artificial Sequence
  dgRNA
  Tgm5
gggcctccacgggga

SEQ ID NO: 76775 - DNA, 15 bp, Artificial Sequence
  dgRNA
  Tgm5
gatggggcctccacg

SEQ ID NO: 76776 - DNA, 15 bp, Artificial Sequence
  dgRNA
  Gpr37l1
cccggttgcagtgat

SEQ ID NO: 76777 - DNA, 15 bp, Artificial Sequence
  dgRNA
  Gpr37l1
caatctgccccgctg

SEQ ID NO: 76778 - DNA, 15 bp, Artificial Sequence
  dgRNA
  Gpr37l1
gcctgaaaacggatg

SEQ ID NO: 76779 - DNA, 15 bp, Artificial Sequence
  dgRNA
  Gpr37l1
gaaaacggatgtggt

SEQ ID NO: 76780 - DNA, 15 bp, Artificial Sequence
  dgRNA
  Apmap
cagcactcggacttg

SEQ ID NO: 76781 - DNA, 15 bp, Artificial Sequence
  dgRNA
  Apmap
tcggctcactgaggg

SEQ ID NO: 76782 - DNA, 15 bp, Artificial Sequence
  dgRNA
  Apmap
gtgccaatctccaaa

SEQ ID NO: 76783 - DNA, 15 bp, Artificial Sequence
  dgRNA
  Apmap
gccaatctccaaaag

SEQ ID NO: 76784 - DNA, 15 bp, Artificial Sequence
  dgRNA
  Klhl7
acggttgcaagcgaa

SEQ ID NO: 76785 - DNA, 15 bp, Artificial Sequence
  dgRNA
  Klhl7
cacggttgcaagcga

SEQ ID NO: 76786 - DNA, 15 bp, Artificial Sequence
  dgRNA
  Upk3a
gagctttagttgctc

SEQ ID NO: 76787 - DNA, 15 bp, Artificial Sequence
  dgRNA
  Upk3a
tttagttgctctggg

SEQ ID NO: 76788 - DNA, 15 bp, Artificial Sequence
  dgRNA
  Upk3a
ttagttgctctgggc

SEQ ID NO: 76789 - DNA, 15 bp, Artificial Sequence
  dgRNA
  Upk3a
ggggaggcttcggat

SEQ ID NO: 76790 - DNA, 15 bp, Artificial Sequence
  dgRNA
  Col6a6
gcagtccaggagttt

SEQ ID NO: 76791 - DNA, 15 bp, Artificial Sequence
  dgRNA
  Col6a6
acgttgcagagaaac

SEQ ID NO: 76792 - DNA, 15 bp, Artificial Sequence
  dgRNA
  Col6a6
ctaaccgctcaggag

SEQ ID NO: 76793 - DNA, 15 bp, Artificial Sequence
  dgRNA
  Col6a6
tagtactaaccgctc

SEQ ID NO: 76794 - DNA, 15 bp, Artificial Sequence
  dgRNA
  Pbxip1
ccaaatttactttgc

SEQ ID NO: 76795 - DNA, 15 bp, Artificial Sequence
  dgRNA
  Pbxip1
aagtcgacttttcac

SEQ ID NO: 76796 - DNA, 15 bp, Artificial Sequence
  dgRNA
  Pbxip1
agtacctctctccct

SEQ ID NO: 76797 - DNA, 15 bp, Artificial Sequence
  dgRNA
  Pbxip1
tgaacgcccaggcag

SEQ ID NO: 76798 - DNA, 15 bp, Artificial Sequence
  dgRNA
  Gdpd5
gctgcccaactgcgc

SEQ ID NO: 76799 - DNA, 15 bp, Artificial Sequence
  dgRNA
  Gdpd5
ctgcccaactgcgcc

SEQ ID NO: 76800 - DNA, 15 bp, Artificial Sequence
  dgRNA
  Gdpd5
tgcccaactgcgccg

SEQ ID NO: 76801 - DNA, 15 bp, Artificial Sequence
  dgRNA
  Gdpd5
aactgcgccggggac

SEQ ID NO: 76802 - DNA, 15 bp, Artificial Sequence
  dgRNA
  Kcnj9
ttcgtccctataaag

SEQ ID NO: 76803 - DNA, 15 bp, Artificial Sequence
  dgRNA
  Kcnj9
tgactctccgtgtcc

SEQ ID NO: 76804 - DNA, 15 bp, Artificial Sequence
  dgRNA
  Kcnj9
ctctccgtgtccagg

SEQ ID NO: 76805 - DNA, 15 bp, Artificial Sequence
  dgRNA
  Kcnj9
aatagctgtggcgtg

SEQ ID NO: 76806 - DNA, 15 bp, Artificial Sequence
  dgRNA
  Clec4d
tagattttgtgcaca

SEQ ID NO: 76807 - DNA, 15 bp, Artificial Sequence
  dgRNA
  Clec2g
tatggggtatggatt

SEQ ID NO: 76808 - DNA, 15 bp, Artificial Sequence
  dgRNA
  Clec2g
tatggatttggatcc

SEQ ID NO: 76809 - DNA, 15 bp, Artificial Sequence
  dgRNA
  Clec2g
ctcgagctaccagat

SEQ ID NO: 76810 - DNA, 15 bp, Artificial Sequence
  dgRNA
  Clec2g
agctaccagattggc

SEQ ID NO: 76811 - DNA, 15 bp, Artificial Sequence
  dgRNA
  Actr2
cccggaagcagaacg

SEQ ID NO: 76812 - DNA, 15 bp, Artificial Sequence
  dgRNA
  Actr2
gcagaacgaggcgag

SEQ ID NO: 76813 - DNA, 15 bp, Artificial Sequence
  dgRNA
  Actr2
cagaacgaggcgaga

SEQ ID NO: 76814 - DNA, 15 bp, Artificial Sequence
  dgRNA
  Actr2
gcgagagggcgcgcc

SEQ ID NO: 76815 - DNA, 15 bp, Artificial Sequence
  dgRNA
  Ssbp1
gcgggctccgtgcgc

SEQ ID NO: 76816 - DNA, 15 bp, Artificial Sequence
  dgRNA
  Ssbp1
ccggaagcgagccgc

SEQ ID NO: 76817 - DNA, 15 bp, Artificial Sequence
  dgRNA
  Ssbp1
gaagcgagccgctgg

SEQ ID NO: 76818 - DNA, 15 bp, Artificial Sequence
  dgRNA
  Ssbp1
cgagccgctggcggt

SEQ ID NO: 76819 - DNA, 15 bp, Artificial Sequence
  dgRNA
  Dlgap1
ccacttcgtagcagc

SEQ ID NO: 76820 - DNA, 15 bp, Artificial Sequence
  dgRNA
  Dlgap1
tcgtagcagccggag

SEQ ID NO: 76821 - DNA, 15 bp, Artificial Sequence
  dgRNA
  Dlgap1
cgtagcagccggagc

SEQ ID NO: 76822 - DNA, 15 bp, Artificial Sequence
  dgRNA
  Dlgap1
gcagccggagcgggt

SEQ ID NO: 76823 - DNA, 15 bp, Artificial Sequence
  dgRNA
  4930563D23Rik
ccaccataaaaagat

SEQ ID NO: 76824 - DNA, 15 bp, Artificial Sequence
  dgRNA
  4930563D23Rik
aaaaagatcggttct

SEQ ID NO: 76825 - DNA, 15 bp, Artificial Sequence
  dgRNA
  4930563D23Rik
ttctaggagtgacac

SEQ ID NO: 76826 - DNA, 15 bp, Artificial Sequence
  dgRNA
  4930563D23Rik
tctaggagtgacact

SEQ ID NO: 76827 - DNA, 15 bp, Artificial Sequence
  dgRNA
  Cyp3a41a
tcatataagtacttc

SEQ ID NO: 76828 - DNA, 15 bp, Artificial Sequence
  dgRNA
  Cyp3a41a
aagtacttatatgac

SEQ ID NO: 76829 - DNA, 15 bp, Artificial Sequence
  dgRNA
  Zfp26
atggaagctataggc

SEQ ID NO: 76830 - DNA, 15 bp, Artificial Sequence
  dgRNA
  Zfp26
gcagtgcatctgccc

SEQ ID NO: 76831 - DNA, 15 bp, Artificial Sequence
  dgRNA
  Zfp26
agaccccgtacttcc

SEQ ID NO: 76832 - DNA, 15 bp, Artificial Sequence
  dgRNA
  Zfp26
gtttaactttgcact

SEQ ID NO: 76833 - DNA, 15 bp, Artificial Sequence
  dgRNA
  Sec1
tctcccaacacggat

SEQ ID NO: 76834 - DNA, 15 bp, Artificial Sequence
  dgRNA
  Sec1
ctcccaacacggatg

SEQ ID NO: 76835 - DNA, 15 bp, Artificial Sequence
  dgRNA
  Sec1
gacaaataacctata

SEQ ID NO: 76836 - DNA, 15 bp, Artificial Sequence
  dgRNA
  Sec1
acctataaggctcac

SEQ ID NO: 76837 - DNA, 15 bp, Artificial Sequence
  dgRNA
  Chchd2
tccagtttacttgag

SEQ ID NO: 76838 - DNA, 15 bp, Artificial Sequence
  dgRNA
  Chchd2
gtggagtaggccagc

SEQ ID NO: 76839 - DNA, 15 bp, Artificial Sequence
  dgRNA
  Chchd2
aggccagccggccat

SEQ ID NO: 76840 - DNA, 15 bp, Artificial Sequence
  dgRNA
  Chchd2
cctccaccattgaat

SEQ ID NO: 76841 - DNA, 15 bp, Artificial Sequence
  dgRNA
  Pcdhgc5
cagatttttcagcga

SEQ ID NO: 76842 - DNA, 15 bp, Artificial Sequence
  dgRNA
  Pcdhgc5
cagcgacggttccca

SEQ ID NO: 76843 - DNA, 15 bp, Artificial Sequence
  dgRNA
  Pcdhgc5
ggttcccaaggtttc

SEQ ID NO: 76844 - DNA, 15 bp, Artificial Sequence
  dgRNA
  Pcdhgc5
aggtttccgggaccg

SEQ ID NO: 76845 - DNA, 15 bp, Artificial Sequence
  dgRNA
  Qars
ctatgaagtcccttc

SEQ ID NO: 76846 - DNA, 15 bp, Artificial Sequence
  dgRNA
  Qars
cacttaaaaagtacc

SEQ ID NO: 76847 - DNA, 15 bp, Artificial Sequence
  dgRNA
  Qars
agtaccaggtttatg

SEQ ID NO: 76848 - DNA, 15 bp, Artificial Sequence
  dgRNA
  Qars
atgtggtccctaggt

SEQ ID NO: 76849 - DNA, 15 bp, Artificial Sequence
  dgRNA
  Hspbp1
cctagaaaagaggcg

SEQ ID NO: 76850 - DNA, 15 bp, Artificial Sequence
  dgRNA
  Hspbp1
agaggcggggaatat

SEQ ID NO: 76851 - DNA, 15 bp, Artificial Sequence
  dgRNA
  Hspbp1
aatatgggcataggc

SEQ ID NO: 76852 - DNA, 15 bp, Artificial Sequence
  dgRNA
  Hspbp1
atatgggcataggcg

SEQ ID NO: 76853 - DNA, 15 bp, Artificial Sequence
  dgRNA
  Ube2e1
ttcccctggtcaccc

SEQ ID NO: 76854 - DNA, 15 bp, Artificial Sequence
  dgRNA
  Ube2e1
gcccccaatcccgcc

SEQ ID NO: 76855 - DNA, 15 bp, Artificial Sequence
  dgRNA
  Ube2e1
cccgcccggttgcct

SEQ ID NO: 76856 - DNA, 15 bp, Artificial Sequence
  dgRNA
  Ube2e1
tgcctcggctccgcc

SEQ ID NO: 76857 - DNA, 15 bp, Artificial Sequence
  dgRNA
  Mdc1
gccgccgccggtaac

SEQ ID NO: 76858 - DNA, 15 bp, Artificial Sequence
  dgRNA
  Mdc1
tggcgccagactctc

SEQ ID NO: 76859 - DNA, 15 bp, Artificial Sequence
  dgRNA
  Mdc1
tctctggtaggcgtt

SEQ ID NO: 76860 - DNA, 15 bp, Artificial Sequence
  dgRNA
  Mdc1
gtttggaaatctgcg

SEQ ID NO: 76861 - DNA, 15 bp, Artificial Sequence
  dgRNA
  Gm590
catcccttgagcaga

SEQ ID NO: 76862 - DNA, 15 bp, Artificial Sequence
  dgRNA
  Gm590
agttcggagcttgtc

SEQ ID NO: 76863 - DNA, 15 bp, Artificial Sequence
  dgRNA
  Gm590
ttgagatgatacaag

SEQ ID NO: 76864 - DNA, 15 bp, Artificial Sequence
  dgRNA
  Gm590
actgcctagttcacg

SEQ ID NO: 76865 - DNA, 15 bp, Artificial Sequence
  dgRNA
  Pik3cd
gtgcggactgtcagt

SEQ ID NO: 76866 - DNA, 15 bp, Artificial Sequence
  dgRNA
  Pik3cd
cggactgtcagtagg

SEQ ID NO: 76867 - DNA, 15 bp, Artificial Sequence
  dgRNA
  Pik3cd
ggactgtcagtaggc

SEQ ID NO: 76868 - DNA, 15 bp, Artificial Sequence
  dgRNA
  Pik3cd
tgcgcgccccgcctc

SEQ ID NO: 76869 - DNA, 15 bp, Artificial Sequence
  dgRNA
  Gramd3
aatgtttcgactgct

SEQ ID NO: 76870 - DNA, 15 bp, Artificial Sequence
  dgRNA
  Gramd3
aaagacgggttcaac

SEQ ID NO: 76871 - DNA, 15 bp, Artificial Sequence
  dgRNA
  Gramd3
ctctgtctcgtgggt

SEQ ID NO: 76872 - DNA, 15 bp, Artificial Sequence
  dgRNA
  Gramd3
tctgtctcgtgggtt

SEQ ID NO: 76873 - DNA, 15 bp, Artificial Sequence
  dgRNA
  Trit1
atctcagctagtcga

SEQ ID NO: 76874 - DNA, 15 bp, Artificial Sequence
  dgRNA
  Trit1
aaggcagttacgtca

SEQ ID NO: 76875 - DNA, 15 bp, Artificial Sequence
  dgRNA
  Trit1
aggcagttacgtcat

SEQ ID NO: 76876 - DNA, 15 bp, Artificial Sequence
  dgRNA
  Trit1
tgggcctcctaagct

SEQ ID NO: 76877 - DNA, 15 bp, Artificial Sequence
  dgRNA
  Olfr30
ctatgatctcaataa

SEQ ID NO: 76878 - DNA, 15 bp, Artificial Sequence
  dgRNA
  Olfr30
ctacaaatactggct

SEQ ID NO: 76879 - DNA, 15 bp, Artificial Sequence
  dgRNA
  Olfr30
gggtcattatttcac

SEQ ID NO: 76880 - DNA, 15 bp, Artificial Sequence
  dgRNA
  Olfr30
tagccagtatttgta

SEQ ID NO: 76881 - DNA, 15 bp, Artificial Sequence
  dgRNA
  Tmem206
gcttgcctctctagc

SEQ ID NO: 76882 - DNA, 15 bp, Artificial Sequence
  dgRNA
  Tmem206
tgcctctctagcggg

SEQ ID NO: 76883 - DNA, 15 bp, Artificial Sequence
  dgRNA
  Tmem206
tttccccaccgctcc

SEQ ID NO: 76884 - DNA, 15 bp, Artificial Sequence
  dgRNA
  Tmem206
tcccagcgtcgcccg

SEQ ID NO: 76885 - DNA, 15 bp, Artificial Sequence
  dgRNA
  Gm14548
ataccctctgccatt

SEQ ID NO: 76886 - DNA, 15 bp, Artificial Sequence
  dgRNA
  Tssk2
tatgacttcattcgc

SEQ ID NO: 76887 - DNA, 15 bp, Artificial Sequence
  dgRNA
  Tssk2
cattcgctggtcact

SEQ ID NO: 76888 - DNA, 15 bp, Artificial Sequence
  dgRNA
  Tssk2
tgagcgttccactcc

SEQ ID NO: 76889 - DNA, 15 bp, Artificial Sequence
  dgRNA
  Tssk2
tgtggtaaccttccc

SEQ ID NO: 76890 - DNA, 15 bp, Artificial Sequence
  dgRNA
  Ercc4
aaacgatgtcgattc

SEQ ID NO: 76891 - DNA, 15 bp, Artificial Sequence
  dgRNA
  Ercc4
ctgaactgtcggtat

SEQ ID NO: 76892 - DNA, 15 bp, Artificial Sequence
  dgRNA
  Ercc4
aactgtcggtattgg

SEQ ID NO: 76893 - DNA, 15 bp, Artificial Sequence
  dgRNA
  Ercc4
tattggaggattacg

SEQ ID NO: 76894 - DNA, 15 bp, Artificial Sequence
  dgRNA
  Matn2
caaggagagcgtctt

SEQ ID NO: 76895 - DNA, 15 bp, Artificial Sequence
  dgRNA
  Matn2
tctttggccccgagc

SEQ ID NO: 76896 - DNA, 15 bp, Artificial Sequence
  dgRNA
  Matn2
ctttggccccgagct

SEQ ID NO: 76897 - DNA, 15 bp, Artificial Sequence
  dgRNA
  Matn2
tttggccccgagctg

SEQ ID NO: 76898 - DNA, 15 bp, Artificial Sequence
  dgRNA
  Atg3
taagagccgcccgct

SEQ ID NO: 76899 - DNA, 15 bp, Artificial Sequence
  dgRNA
  Atg3
aagagccgcccgcta

SEQ ID NO: 76900 - DNA, 15 bp, Artificial Sequence
  dgRNA
  Atg3
gagcggccattgcgc

SEQ ID NO: 76901 - DNA, 15 bp, Artificial Sequence
  dgRNA
  Atg3
tcattccagcgcttc

SEQ ID NO: 76902 - DNA, 15 bp, Artificial Sequence
  dgRNA
  Colec10
aatgtatggtccatt

SEQ ID NO: 76903 - DNA, 15 bp, Artificial Sequence
  dgRNA
  Colec10
gtgattcttcaacag

SEQ ID NO: 76904 - DNA, 15 bp, Artificial Sequence
  dgRNA
  Agtrap
gcccgttgagcccct

SEQ ID NO: 76905 - DNA, 15 bp, Artificial Sequence
  dgRNA
  Agtrap
gaaatcccgacctcc

SEQ ID NO: 76906 - DNA, 15 bp, Artificial Sequence
  dgRNA
  Agtrap
ggcagtagtagtagc

SEQ ID NO: 76907 - DNA, 15 bp, Artificial Sequence
  dgRNA
  Agtrap
ccggctgcagtcacg

SEQ ID NO: 76908 - DNA, 15 bp, Artificial Sequence
  dgRNA
  Fopnl
ttgacctgtaggact

SEQ ID NO: 76909 - DNA, 15 bp, Artificial Sequence
  dgRNA
  Fopnl
ttgggcggcgacaaa

SEQ ID NO: 76910 - DNA, 15 bp, Artificial Sequence
  dgRNA
  Fopnl
agttgggtacagatt

SEQ ID NO: 76911 - DNA, 15 bp, Artificial Sequence
  dgRNA
  Fopnl
gtagcccgcctcaca

SEQ ID NO: 76912 - DNA, 15 bp, Artificial Sequence
  dgRNA
  Negr1
ttcgcgctgccaagc

SEQ ID NO: 76913 - DNA, 15 bp, Artificial Sequence
  dgRNA
  Negr1
agccggactagacct

SEQ ID NO: 76914 - DNA, 15 bp, Artificial Sequence
  dgRNA
  Negr1
tgcgagccgcggggc

SEQ ID NO: 76915 - DNA, 15 bp, Artificial Sequence
  dgRNA
  Negr1
gctttgcgagccgcg

SEQ ID NO: 76916 - DNA, 15 bp, Artificial Sequence
  dgRNA
  Fam171a2
ggaatcttgggttac

SEQ ID NO: 76917 - DNA, 15 bp, Artificial Sequence
  dgRNA
  Fam171a2
gaatcttgggttacc

SEQ ID NO: 76918 - DNA, 15 bp, Artificial Sequence
  dgRNA
  Fam171a2
tcttgggttaccggg

SEQ ID NO: 76919 - DNA, 15 bp, Artificial Sequence
  dgRNA
  Fam171a2
cttgggttaccgggt

SEQ ID NO: 76920 - DNA, 15 bp, Artificial Sequence
  dgRNA
  Enc1
ctcctgcccgcgtag

SEQ ID NO: 76921 - DNA, 15 bp, Artificial Sequence
  dgRNA
  Enc1
atacgcgccccctcc

SEQ ID NO: 76922 - DNA, 15 bp, Artificial Sequence
  dgRNA
  Enc1
tacgcgccccctccc

SEQ ID NO: 76923 - DNA, 15 bp, Artificial Sequence
  dgRNA
  Enc1
ccgggcgcaacttat

SEQ ID NO: 76924 - DNA, 15 bp, Artificial Sequence
  dgRNA
  Usp31
cgcacgcgcgcccct

SEQ ID NO: 76925 - DNA, 15 bp, Artificial Sequence
  dgRNA
  Usp31
tgctcgctctctccg

SEQ ID NO: 76926 - DNA, 15 bp, Artificial Sequence
  dgRNA
  Usp31
ctccgcggcgctctg

SEQ ID NO: 76927 - DNA, 15 bp, Artificial Sequence
  dgRNA
  Usp31
cgcggcgctctgagg

SEQ ID NO: 76928 - DNA, 15 bp, Artificial Sequence
  dgRNA
  Otogl
tggttgagaagcccg

SEQ ID NO: 76929 - DNA, 15 bp, Artificial Sequence
  dgRNA
  Otogl
tgaagaccgtcactt

SEQ ID NO: 76930 - DNA, 15 bp, Artificial Sequence
  dgRNA
  Otogl
cggtcttcactatga

SEQ ID NO: 76931 - DNA, 15 bp, Artificial Sequence
  dgRNA
  Malt1
ggcccgggtcgctac

SEQ ID NO: 76932 - DNA, 15 bp, Artificial Sequence
  dgRNA
  Malt1
ttcgctccttgccag

SEQ ID NO: 76933 - DNA, 15 bp, Artificial Sequence
  dgRNA
  Malt1
tcgctccttgccagt

SEQ ID NO: 76934 - DNA, 15 bp, Artificial Sequence
  dgRNA
  Malt1
cgctccttgccagtg

SEQ ID NO: 76935 - DNA, 15 bp, Artificial Sequence
  dgRNA
  Bckdhb
ggtatggcttccgtc

SEQ ID NO: 76936 - DNA, 15 bp, Artificial Sequence
  dgRNA
  Bckdhb
gtatggcttccgtct

SEQ ID NO: 76937 - DNA, 15 bp, Artificial Sequence
  dgRNA
  Bckdhb
tggcttccgtctggg

SEQ ID NO: 76938 - DNA, 15 bp, Artificial Sequence
  dgRNA
  Bckdhb
ggcttccgtctgggc

SEQ ID NO: 76939 - DNA, 15 bp, Artificial Sequence
  dgRNA
  Sspn
gcattcccatcacac

SEQ ID NO: 76940 - DNA, 15 bp, Artificial Sequence
  dgRNA
  Sspn
caggtccctgtgcgt

SEQ ID NO: 76941 - DNA, 15 bp, Artificial Sequence
  dgRNA
  Sspn
gttggcgacccccct

SEQ ID NO: 76942 - DNA, 15 bp, Artificial Sequence
  dgRNA
  Sspn
ttggcgacccccctc

SEQ ID NO: 76943 - DNA, 15 bp, Artificial Sequence
  dgRNA
  Aldoart1
tatacccctgaattg

SEQ ID NO: 76944 - DNA, 15 bp, Artificial Sequence
  dgRNA
  Aldoart1
gcacctgcagtccat

SEQ ID NO: 76945 - DNA, 15 bp, Artificial Sequence
  dgRNA
  Aldoart1
atgcgccgcagaatg

SEQ ID NO: 76946 - DNA, 15 bp, Artificial Sequence
  dgRNA
  Aldoart1
cgcagaatgaggttc

SEQ ID NO: 76947 - DNA, 15 bp, Artificial Sequence
  dgRNA
  Snx2
gctctagaaaaagcg

SEQ ID NO: 76948 - DNA, 15 bp, Artificial Sequence
  dgRNA
  Snx2
aagcgcggccccagt

SEQ ID NO: 76949 - DNA, 15 bp, Artificial Sequence
  dgRNA
  Snx2
agcgcggccccagtc

SEQ ID NO: 76950 - DNA, 15 bp, Artificial Sequence
  dgRNA
  Snx2
gcgcggccccagtcg

SEQ ID NO: 76951 - DNA, 15 bp, Artificial Sequence
  dgRNA
  Myo1c
tgggtcttctactgg

SEQ ID NO: 76952 - DNA, 15 bp, Artificial Sequence
  dgRNA
  Myo1c
gggtcttctactgga

SEQ ID NO: 76953 - DNA, 15 bp, Artificial Sequence
  dgRNA
  Myo1c
agccttggcgggcgc

SEQ ID NO: 76954 - DNA, 15 bp, Artificial Sequence
  dgRNA
  Myo1c
gccaccagcacgggg

SEQ ID NO: 76955 - DNA, 15 bp, Artificial Sequence
  dgRNA
  Mamdc2
ttacaagctacatgc

SEQ ID NO: 76956 - DNA, 15 bp, Artificial Sequence
  dgRNA
  Mamdc2
tacaagctacatgca

SEQ ID NO: 76957 - DNA, 15 bp, Artificial Sequence
  dgRNA
  Mamdc2
agctgtttcccaccg

SEQ ID NO: 76958 - DNA, 15 bp, Artificial Sequence
  dgRNA
  Mamdc2
gtttcccaccgtgga

SEQ ID NO: 76959 - DNA, 15 bp, Artificial Sequence
  dgRNA
  Irgm2
agctgttcgggcacc

SEQ ID NO: 76960 - DNA, 15 bp, Artificial Sequence
  dgRNA
  Irgm2
gccgctggccagttg

SEQ ID NO: 76961 - DNA, 15 bp, Artificial Sequence
  dgRNA
  Irgm2
ggccgctggccagtt

SEQ ID NO: 76962 - DNA, 15 bp, Artificial Sequence
  dgRNA
  Irgm2
cggccgctggccagt

SEQ ID NO: 76963 - DNA, 15 bp, Artificial Sequence
  dgRNA
  Olfr830
tgttgcattcttagt

SEQ ID NO: 76964 - DNA, 15 bp, Artificial Sequence
  dgRNA
  Olfr830
cttagttggaataga

SEQ ID NO: 76965 - DNA, 15 bp, Artificial Sequence
  dgRNA
  Olfr830
tgtcctacctaaata

SEQ ID NO: 76966 - DNA, 15 bp, Artificial Sequence
  dgRNA
  Cdkl1
cccgagcaggctgct

SEQ ID NO: 76967 - DNA, 15 bp, Artificial Sequence
  dgRNA
  Cdkl1
acgatttaaaccctc

SEQ ID NO: 76968 - DNA, 15 bp, Artificial Sequence
  dgRNA
  Cdkl1
ctggacctgcagcgc

SEQ ID NO: 76969 - DNA, 15 bp, Artificial Sequence
  dgRNA
  Cdkl1
tggacctgcagcgcg

SEQ ID NO: 76970 - DNA, 15 bp, Artificial Sequence
  dgRNA
  Rfx3
gtggctatgtacatt

SEQ ID NO: 76971 - DNA, 15 bp, Artificial Sequence
  dgRNA
  Adgrf3
atctgcccgaatcac

SEQ ID NO: 76972 - DNA, 15 bp, Artificial Sequence
  dgRNA
  Adgrf3
tctgtcaactcacct

SEQ ID NO: 76973 - DNA, 15 bp, Artificial Sequence
  dgRNA
  Adgrf3
aggaaatttgcatcc

SEQ ID NO: 76974 - DNA, 15 bp, Artificial Sequence
  dgRNA
  Adgrf3
tcctggaacagccgg

SEQ ID NO: 76975 - DNA, 15 bp, Artificial Sequence
  dgRNA
  Cnst
ccacactaggccggg

SEQ ID NO: 76976 - DNA, 15 bp, Artificial Sequence
  dgRNA
  Cnst
agtaaacattacgaa

SEQ ID NO: 76977 - DNA, 15 bp, Artificial Sequence
  dgRNA
  Cnst
ccaggctcctgtgcg

SEQ ID NO: 76978 - DNA, 15 bp, Artificial Sequence
  dgRNA
  Cnst
tgtgcgtggactctc

SEQ ID NO: 76979 - DNA, 15 bp, Artificial Sequence
  dgRNA
  Synj2
tgtagctggttaccc

SEQ ID NO: 76980 - DNA, 15 bp, Artificial Sequence
  dgRNA
  Synj2
ggttacccgggtaac

SEQ ID NO: 76981 - DNA, 15 bp, Artificial Sequence
  dgRNA
  Synj2
gttacccgggtaaca

SEQ ID NO: 76982 - DNA, 15 bp, Artificial Sequence
  dgRNA
  Synj2
gctgttattgagggc

SEQ ID NO: 76983 - DNA, 15 bp, Artificial Sequence
  dgRNA
  Upb1
cccatcaaagatcta

SEQ ID NO: 76984 - DNA, 15 bp, Artificial Sequence
  dgRNA
  Upb1
ggaggcgcctgtgtt

SEQ ID NO: 76985 - DNA, 15 bp, Artificial Sequence
  dgRNA
  Upb1
gaggcgcctgtgtta

SEQ ID NO: 76986 - DNA, 15 bp, Artificial Sequence
  dgRNA
  Upb1
tgcactgatccaacc

SEQ ID NO: 76987 - DNA, 15 bp, Artificial Sequence
  dgRNA
  Ldha
gtgtcgcagcacacg

SEQ ID NO: 76988 - DNA, 15 bp, Artificial Sequence
  dgRNA
  Ldha
ggagccactcttgca

SEQ ID NO: 76989 - DNA, 15 bp, Artificial Sequence
  dgRNA
  Ldha
ctgcgcgcgccgccc

SEQ ID NO: 76990 - DNA, 15 bp, Artificial Sequence
  dgRNA
  Ldha
gcgccgccccggtct

SEQ ID NO: 76991 - DNA, 15 bp, Artificial Sequence
  dgRNA
  Dlgap1
gcatattaagccatt

SEQ ID NO: 76992 - DNA, 15 bp, Artificial Sequence
  dgRNA
  Dlgap1
ccattcggaagagaa

SEQ ID NO: 76993 - DNA, 15 bp, Artificial Sequence
  dgRNA
  Dlgap1
aatacaagattcgaa

SEQ ID NO: 76994 - DNA, 15 bp, Artificial Sequence
  dgRNA
  Dlgap1
aaatacaagattcga

SEQ ID NO: 76995 - DNA, 15 bp, Artificial Sequence
  dgRNA
  Cyp2ab1
gtcagtcatgccttc

SEQ ID NO: 76996 - DNA, 15 bp, Artificial Sequence
  dgRNA
  Cyp2ab1
cattcatacttagct

SEQ ID NO: 76997 - DNA, 15 bp, Artificial Sequence
  dgRNA
  Cyp2ab1
gaaccatgttgttac

SEQ ID NO: 76998 - DNA, 15 bp, Artificial Sequence
  dgRNA
  Cyp2ab1
tccacttgtttatgg

SEQ ID NO: 76999 - DNA, 15 bp, Artificial Sequence
  dgRNA
  Trip10
tcgaggcgtactttg

SEQ ID NO: 77000 - DNA, 15 bp, Artificial Sequence
  dgRNA
  Trip10
aggcgtactttgagg

SEQ ID NO: 77001 - DNA, 15 bp, Artificial Sequence
  dgRNA
  Trip10
ctttgaggtggcgca

SEQ ID NO: 77002 - DNA, 15 bp, Artificial Sequence
  dgRNA
  Trip10
cgcatggccctttaa

SEQ ID NO: 77003 - DNA, 15 bp, Artificial Sequence
  dgRNA
  Olfr656
ccaggtaatatgata

SEQ ID NO: 77004 - DNA, 15 bp, Artificial Sequence
  dgRNA
  Olfr656
tagctacagaacgtt

SEQ ID NO: 77005 - DNA, 15 bp, Artificial Sequence
  dgRNA
  Olfr656
ccatatcatattacc

SEQ ID NO: 77006 - DNA, 15 bp, Artificial Sequence
  dgRNA
  Shb
tgagacacgtctgtg

SEQ ID NO: 77007 - DNA, 15 bp, Artificial Sequence
  dgRNA
  Shb
agacacgtctgtgcg

SEQ ID NO: 77008 - DNA, 15 bp, Artificial Sequence
  dgRNA
  Shb
gcgagatccaaagct

SEQ ID NO: 77009 - DNA, 15 bp, Artificial Sequence
  dgRNA
  Shb
gatccaaagctcggt

SEQ ID NO: 77010 - DNA, 15 bp, Artificial Sequence
  dgRNA
  Jam2
tttttttgcgccaag

SEQ ID NO: 77011 - DNA, 15 bp, Artificial Sequence
  dgRNA
  Jam2
gctggcagcctagcg

SEQ ID NO: 77012 - DNA, 15 bp, Artificial Sequence
  dgRNA
  Jam2
ctggcagcctagcgc

SEQ ID NO: 77013 - DNA, 15 bp, Artificial Sequence
  dgRNA
  Jam2
tgttttgcctagcgt

SEQ ID NO: 77014 - DNA, 15 bp, Artificial Sequence
  dgRNA
  Zfp612
gcgggcaccccagag

SEQ ID NO: 77015 - DNA, 15 bp, Artificial Sequence
  dgRNA
  Zfp612
cgggcaccccagaga

SEQ ID NO: 77016 - DNA, 15 bp, Artificial Sequence
  dgRNA
  Zfp612
gcagcactcctagag

SEQ ID NO: 77017 - DNA, 15 bp, Artificial Sequence
  dgRNA
  Zfp612
gcactcctagagggg

SEQ ID NO: 77018 - DNA, 15 bp, Artificial Sequence
  dgRNA
  Zfp518b
cgcctggccctcctt

SEQ ID NO: 77019 - DNA, 15 bp, Artificial Sequence
  dgRNA
  Zfp518b
ctatccatgggcgcc

SEQ ID NO: 77020 - DNA, 15 bp, Artificial Sequence
  dgRNA
  Zfp518b
caatggactatccat

SEQ ID NO: 77021 - DNA, 15 bp, Artificial Sequence
  dgRNA
  Zfp518b
tcaatggactatcca

SEQ ID NO: 77022 - DNA, 15 bp, Artificial Sequence
  dgRNA
  Pla2g2e
gcgctccctactccc

SEQ ID NO: 77023 - DNA, 15 bp, Artificial Sequence
  dgRNA
  Pla2g2e
cgctccctactccca

SEQ ID NO: 77024 - DNA, 15 bp, Artificial Sequence
  dgRNA
  Pla2g2e
tcgatgccatgctgt

SEQ ID NO: 77025 - DNA, 15 bp, Artificial Sequence
  dgRNA
  Pla2g2e
cgatgccatgctgtt

SEQ ID NO: 77026 - DNA, 15 bp, Artificial Sequence
  dgRNA
  Thnsl2
cgatagaataaaaga

SEQ ID NO: 77027 - DNA, 15 bp, Artificial Sequence
  dgRNA
  Slc24a1
aaaagtctaccccct

SEQ ID NO: 77028 - DNA, 15 bp, Artificial Sequence
  dgRNA
  Slc24a1
aaagtctaccccctc

SEQ ID NO: 77029 - DNA, 15 bp, Artificial Sequence
  dgRNA
  Slc24a1
ccctcgggtttgtta

SEQ ID NO: 77030 - DNA, 15 bp, Artificial Sequence
  dgRNA
  Slc24a1
cctcgggtttgttat

SEQ ID NO: 77031 - DNA, 15 bp, Artificial Sequence
  dgRNA
  Ppp1r1a
ctggatgccggcccg

SEQ ID NO: 77032 - DNA, 15 bp, Artificial Sequence
  dgRNA
  Ppp1r1a
tggatgccggcccgc

SEQ ID NO: 77033 - DNA, 15 bp, Artificial Sequence
  dgRNA
  Ppp1r1a
atgccggcccgcggg

SEQ ID NO: 77034 - DNA, 15 bp, Artificial Sequence
  dgRNA
  Ppp1r1a
gcccgcgggtggtct

SEQ ID NO: 77035 - DNA, 15 bp, Artificial Sequence
  dgRNA
  Susd1
attcctaacgtgcca

SEQ ID NO: 77036 - DNA, 15 bp, Artificial Sequence
  dgRNA
  Susd1
cctaacgtgccaagg

SEQ ID NO: 77037 - DNA, 15 bp, Artificial Sequence
  dgRNA
  Susd1
ctaacgtgccaagga

SEQ ID NO: 77038 - DNA, 15 bp, Artificial Sequence
  dgRNA
  Susd1
cgtccagcaagtagc

SEQ ID NO: 77039 - DNA, 15 bp, Artificial Sequence
  dgRNA
  Slc22a13
ttaacagacctttgt

SEQ ID NO: 77040 - DNA, 15 bp, Artificial Sequence
  dgRNA
  Nup205
cactagtcaactgca

SEQ ID NO: 77041 - DNA, 15 bp, Artificial Sequence
  dgRNA
  Nup205
ctcgaaataaaacta

SEQ ID NO: 77042 - DNA, 15 bp, Artificial Sequence
  dgRNA
  Nup205
tcgaaataaaactac

SEQ ID NO: 77043 - DNA, 15 bp, Artificial Sequence
  dgRNA
  Nup205
agctagtctccgaac

SEQ ID NO: 77044 - DNA, 15 bp, Artificial Sequence
  dgRNA
  Ccdc57
ggcacagggccccgt

SEQ ID NO: 77045 - DNA, 15 bp, Artificial Sequence
  dgRNA
  Ccdc57
gggccccgtaggtgt

SEQ ID NO: 77046 - DNA, 15 bp, Artificial Sequence
  dgRNA
  Ccdc57
tggctcgcactactc

SEQ ID NO: 77047 - DNA, 15 bp, Artificial Sequence
  dgRNA
  Ccdc57
ggctcgcactactca

SEQ ID NO: 77048 - DNA, 15 bp, Artificial Sequence
  dgRNA
  Gdap2
gttctgcgatgcaga

SEQ ID NO: 77049 - DNA, 15 bp, Artificial Sequence
  dgRNA
  Gdap2
cgatgcagacggccg

SEQ ID NO: 77050 - DNA, 15 bp, Artificial Sequence
  dgRNA
  Gdap2
agacggccgcggcaa

SEQ ID NO: 77051 - DNA, 15 bp, Artificial Sequence
  dgRNA
  Gdap2
gacggccgcggcaaa

SEQ ID NO: 77052 - DNA, 15 bp, Artificial Sequence
  dgRNA
  Olfr101
tattggataaatacc

SEQ ID NO: 77053 - DNA, 15 bp, Artificial Sequence
  dgRNA
  Mrto4
caaacaccgacgtcc

SEQ ID NO: 77054 - DNA, 15 bp, Artificial Sequence
  dgRNA
  Mrto4
ggtcttcgtagaccg

SEQ ID NO: 77055 - DNA, 15 bp, Artificial Sequence
  dgRNA
  Mrto4
gtagaccgcggccgc

SEQ ID NO: 77056 - DNA, 15 bp, Artificial Sequence
  dgRNA
  Mrto4
tagaccgcggccgca

SEQ ID NO: 77057 - DNA, 15 bp, Artificial Sequence
  dgRNA
  Slc15a5
cataagtgatagtct

SEQ ID NO: 77058 - DNA, 15 bp, Artificial Sequence
  dgRNA
  Slc15a5
accctattcctctaa

SEQ ID NO: 77059 - DNA, 15 bp, Artificial Sequence
  dgRNA
  Larp1b
cccgccgctgccacc

SEQ ID NO: 77060 - DNA, 15 bp, Artificial Sequence
  dgRNA
  Larp1b
ccgctgccacccggg

SEQ ID NO: 77061 - DNA, 15 bp, Artificial Sequence
  dgRNA
  Larp1b
aggacccgcccgccg

SEQ ID NO: 77062 - DNA, 15 bp, Artificial Sequence
  dgRNA
  Larp1b
cccgcccgccgtggc

SEQ ID NO: 77063 - DNA, 15 bp, Artificial Sequence
  dgRNA
  Arpc1a
cctagcgctgacgag

SEQ ID NO: 77064 - DNA, 15 bp, Artificial Sequence
  dgRNA
  Arpc1a
agaacacgccaacaa

SEQ ID NO: 77065 - DNA, 15 bp, Artificial Sequence
  dgRNA
  Arpc1a
agcgccagctgagag

SEQ ID NO: 77066 - DNA, 15 bp, Artificial Sequence
  dgRNA
  Arpc1a
gcgtgcttgtggaac

SEQ ID NO: 77067 - DNA, 15 bp, Artificial Sequence
  dgRNA
  Tmem263
catgccgccctcctc

SEQ ID NO: 77068 - DNA, 15 bp, Artificial Sequence
  dgRNA
  Tmem263
atgccgccctcctca

SEQ ID NO: 77069 - DNA, 15 bp, Artificial Sequence
  dgRNA
  Tmem263
tagttccctcgagcc

SEQ ID NO: 77070 - DNA, 15 bp, Artificial Sequence
  dgRNA
  Tmem263
ctcgagcccggagag

SEQ ID NO: 77071 - DNA, 15 bp, Artificial Sequence
  dgRNA
  Gucy1a2
gttgctcctgaaacg

SEQ ID NO: 77072 - DNA, 15 bp, Artificial Sequence
  dgRNA
  Gucy1a2
acgcggcgacagaag

SEQ ID NO: 77073 - DNA, 15 bp, Artificial Sequence
  dgRNA
  Gucy1a2
tccaatgagtatgct

SEQ ID NO: 77074 - DNA, 15 bp, Artificial Sequence
  dgRNA
  Gucy1a2
acgtgacgcccgccg

SEQ ID NO: 77075 - DNA, 15 bp, Artificial Sequence
  dgRNA
  Lce1h
gttagaaaaccatgt

SEQ ID NO: 77076 - DNA, 15 bp, Artificial Sequence
  dgRNA
  Lce1h
gacaggcatgcaatg

SEQ ID NO: 77077 - DNA, 15 bp, Artificial Sequence
  dgRNA
  Lce1h
atcttaaggcatgac

SEQ ID NO: 77078 - DNA, 15 bp, Artificial Sequence
  dgRNA
  Lce1h
ctaacagatcattac

SEQ ID NO: 77079 - DNA, 15 bp, Artificial Sequence
  dgRNA
  Olfr967
ggaactgcttgacct

SEQ ID NO: 77080 - DNA, 15 bp, Artificial Sequence
  dgRNA
  Olfr967
acttccatatgtgat

SEQ ID NO: 77081 - DNA, 15 bp, Artificial Sequence
  dgRNA
  Olfr967
catatgtgataggac

SEQ ID NO: 77082 - DNA, 15 bp, Artificial Sequence
  dgRNA
  1700037H04Rik
ccctcaagccaatga

SEQ ID NO: 77083 - DNA, 15 bp, Artificial Sequence
  dgRNA
  1700037H04Rik
tcaagccaatgaagg

SEQ ID NO: 77084 - DNA, 15 bp, Artificial Sequence
  dgRNA
  1700037H04Rik
ggcgcgaggctgatg

SEQ ID NO: 77085 - DNA, 15 bp, Artificial Sequence
  dgRNA
  1700037H04Rik
gaggctgatgcggcg

SEQ ID NO: 77086 - DNA, 15 bp, Artificial Sequence
  dgRNA
  Knstrn
gctatttcagcccac

SEQ ID NO: 77087 - DNA, 15 bp, Artificial Sequence
  dgRNA
  Knstrn
tggtgtccttcaagt

SEQ ID NO: 77088 - DNA, 15 bp, Artificial Sequence
  dgRNA
  Knstrn
ttgtgacttgacgct

SEQ ID NO: 77089 - DNA, 15 bp, Artificial Sequence
  dgRNA
  Knstrn
cacgtgtctgccttc

SEQ ID NO: 77090 - DNA, 15 bp, Artificial Sequence
  dgRNA
  Olfr984
tgaccaggtcacacc

SEQ ID NO: 77091 - DNA, 15 bp, Artificial Sequence
  dgRNA
  Lce3c
ggtggtaattgtagt

SEQ ID NO: 77092 - DNA, 15 bp, Artificial Sequence
  dgRNA
  Lce3c
cctagtaaggatatg

SEQ ID NO: 77093 - DNA, 15 bp, Artificial Sequence
  dgRNA
  Lce3c
catgcctgcctagta

SEQ ID NO: 77094 - DNA, 15 bp, Artificial Sequence
  dgRNA
  Lce3c
accagcatggaacct

SEQ ID NO: 77095 - DNA, 15 bp, Artificial Sequence
  dgRNA
  Dusp22
agtaatgccgcgtcc

SEQ ID NO: 77096 - DNA, 15 bp, Artificial Sequence
  dgRNA
  Dusp22
gtaatgccgcgtccc

SEQ ID NO: 77097 - DNA, 15 bp, Artificial Sequence
  dgRNA
  Dusp22
atgccgcgtcccggg

SEQ ID NO: 77098 - DNA, 15 bp, Artificial Sequence
  dgRNA
  Dusp22
cagcgagcgccgccc

SEQ ID NO: 77099 - DNA, 15 bp, Artificial Sequence
  dgRNA
  Cops6
tgagctactaagtac

SEQ ID NO: 77100 - DNA, 15 bp, Artificial Sequence
  dgRNA
  Cops6
tgcaccgctccccga

SEQ ID NO: 77101 - DNA, 15 bp, Artificial Sequence
  dgRNA
  Cops6
gtacttagtagctca

SEQ ID NO: 77102 - DNA, 15 bp, Artificial Sequence
  dgRNA
  Cops6
agtacttagtagctc

SEQ ID NO: 77103 - DNA, 15 bp, Artificial Sequence
  dgRNA
  Myo16
acacaataatgtcca

SEQ ID NO: 77104 - DNA, 15 bp, Artificial Sequence
  dgRNA
  Myo16
tagcaacctgaaata

SEQ ID NO: 77105 - DNA, 15 bp, Artificial Sequence
  dgRNA
  Snurf
ggacattccggtcag

SEQ ID NO: 77106 - DNA, 15 bp, Artificial Sequence
  dgRNA
  Snurf
gacattccggtcaga

SEQ ID NO: 77107 - DNA, 15 bp, Artificial Sequence
  dgRNA
  Snurf
tgggacgcatgcgta

SEQ ID NO: 77108 - DNA, 15 bp, Artificial Sequence
  dgRNA
  Snurf
aagactagcgcagag

SEQ ID NO: 77109 - DNA, 15 bp, Artificial Sequence
  dgRNA
  Zfp523
tcgcctgaggagact

SEQ ID NO: 77110 - DNA, 15 bp, Artificial Sequence
  dgRNA
  Zfp523
ggagactcggcggcc

SEQ ID NO: 77111 - DNA, 15 bp, Artificial Sequence
  dgRNA
  Zfp523
gagactcggcggcct

SEQ ID NO: 77112 - DNA, 15 bp, Artificial Sequence
  dgRNA
  Zfp523
tgggctccggggccc

SEQ ID NO: 77113 - DNA, 15 bp, Artificial Sequence
  dgRNA
  4930562C15Rik
gccttatgtaatcag

SEQ ID NO: 77114 - DNA, 15 bp, Artificial Sequence
  dgRNA
  4930562C15Rik
ccttatgtaatcaga

SEQ ID NO: 77115 - DNA, 15 bp, Artificial Sequence
  dgRNA
  4930562C15Rik
ccctctgattacata

SEQ ID NO: 77116 - DNA, 15 bp, Artificial Sequence
  dgRNA
  4930562C15Rik
gcttccgagaaccca

SEQ ID NO: 77117 - DNA, 15 bp, Artificial Sequence
  dgRNA
  Ddias
cctagctttacaaga

SEQ ID NO: 77118 - DNA, 15 bp, Artificial Sequence
  dgRNA
  Ddias
ctagctttacaagaa

SEQ ID NO: 77119 - DNA, 15 bp, Artificial Sequence
  dgRNA
  Ddias
gaagggtcgcttgcc

SEQ ID NO: 77120 - DNA, 15 bp, Artificial Sequence
  dgRNA
  Ddias
aagggtcgcttgccc

SEQ ID NO: 77121 - DNA, 15 bp, Artificial Sequence
  dgRNA
  Plekhg2
agtcagccccgaggc

SEQ ID NO: 77122 - DNA, 15 bp, Artificial Sequence
  dgRNA
  Plekhg2
ggcccgtcccgtacc

SEQ ID NO: 77123 - DNA, 15 bp, Artificial Sequence
  dgRNA
  Plekhg2
ggcttcgaagaccgt

SEQ ID NO: 77124 - DNA, 15 bp, Artificial Sequence
  dgRNA
  Plekhg2
agaccgtaggatctg

SEQ ID NO: 77125 - DNA, 15 bp, Artificial Sequence
  dgRNA
  Fkbp7
ggcgaaagaaacctg

SEQ ID NO: 77126 - DNA, 15 bp, Artificial Sequence
  dgRNA
  Fkbp7
aagaaacctgcggac

SEQ ID NO: 77127 - DNA, 15 bp, Artificial Sequence
  dgRNA
  Fkbp7
agaaacctgcggaca

SEQ ID NO: 77128 - DNA, 15 bp, Artificial Sequence
  dgRNA
  Fkbp7
cagagtacagccaac

SEQ ID NO: 77129 - DNA, 15 bp, Artificial Sequence
  dgRNA
  Dph2
ttagagggcaccggc

SEQ ID NO: 77130 - DNA, 15 bp, Artificial Sequence
  dgRNA
  Dph2
agggcaccggcaggc

SEQ ID NO: 77131 - DNA, 15 bp, Artificial Sequence
  dgRNA
  Dph2
cggcaggctggcctt

SEQ ID NO: 77132 - DNA, 15 bp, Artificial Sequence
  dgRNA
  Dph2
tggccttagggtatc

SEQ ID NO: 77133 - DNA, 15 bp, Artificial Sequence
  dgRNA
  Prpf4b
cgctctaagtgaatc

SEQ ID NO: 77134 - DNA, 15 bp, Artificial Sequence
  dgRNA
  Prpf4b
atgtgatccagtagt

SEQ ID NO: 77135 - DNA, 15 bp, Artificial Sequence
  dgRNA
  Prpf4b
agtgtagggacctgc

SEQ ID NO: 77136 - DNA, 15 bp, Artificial Sequence
  dgRNA
  Prpf4b
attcacttagagcgc

SEQ ID NO: 77137 - DNA, 15 bp, Artificial Sequence
  dgRNA
  Cox7b
tgccttatgtaaggt

SEQ ID NO: 77138 - DNA, 15 bp, Artificial Sequence
  dgRNA
  Cox7b
ttcctatttcctcgc

SEQ ID NO: 77139 - DNA, 15 bp, Artificial Sequence
  dgRNA
  Cox7b
gatgacaatttctat

SEQ ID NO: 77140 - DNA, 15 bp, Artificial Sequence
  dgRNA
  Cox7b
gcaccagcatcaaaa

SEQ ID NO: 77141 - DNA, 15 bp, Artificial Sequence
  dgRNA
  Syde1
cagcatcgcctgctc

SEQ ID NO: 77142 - DNA, 15 bp, Artificial Sequence
  dgRNA
  Syde1
gcctgctcgggccgc

SEQ ID NO: 77143 - DNA, 15 bp, Artificial Sequence
  dgRNA
  Syde1
ctcgggccgcgggaa

SEQ ID NO: 77144 - DNA, 15 bp, Artificial Sequence
  dgRNA
  Syde1
gaatgcgcttcctgc

SEQ ID NO: 77145 - DNA, 15 bp, Artificial Sequence
  dgRNA
  Mc2r
gaacatatacatcac

SEQ ID NO: 77146 - DNA, 15 bp, Artificial Sequence
  dgRNA
  Mc2r
aatgatccttggagc

SEQ ID NO: 77147 - DNA, 15 bp, Artificial Sequence
  dgRNA
  Cbx4
ccagaccgggggcct

SEQ ID NO: 77148 - DNA, 15 bp, Artificial Sequence
  dgRNA
  Cbx4
cagaccgggggcctc

SEQ ID NO: 77149 - DNA, 15 bp, Artificial Sequence
  dgRNA
  Cbx4
ccgggggcctcgggt

SEQ ID NO: 77150 - DNA, 15 bp, Artificial Sequence
  dgRNA
  Cbx4
gggcctcgggtaggc

SEQ ID NO: 77151 - DNA, 15 bp, Artificial Sequence
  dgRNA
  Tab1
taggctgatggggtt

SEQ ID NO: 77152 - DNA, 15 bp, Artificial Sequence
  dgRNA
  Tab1
agccgcgcttgctca

SEQ ID NO: 77153 - DNA, 15 bp, Artificial Sequence
  dgRNA
  Tab1
tcctccgctccgccg

SEQ ID NO: 77154 - DNA, 15 bp, Artificial Sequence
  dgRNA
  Tab1
cctccgctccgccgg

SEQ ID NO: 77155 - DNA, 15 bp, Artificial Sequence
  dgRNA
  Pak2
tgataaatgagggac

SEQ ID NO: 77156 - DNA, 15 bp, Artificial Sequence
  dgRNA
  Pak2
cagatgactagacta

SEQ ID NO: 77157 - DNA, 15 bp, Artificial Sequence
  dgRNA
  Pak2
tgaaagcccgcccct

SEQ ID NO: 77158 - DNA, 15 bp, Artificial Sequence
  dgRNA
  Pak2
gaaagcccgcccctc

SEQ ID NO: 77159 - DNA, 15 bp, Artificial Sequence
  dgRNA
  Gm17455
tggtaacctgatggc

SEQ ID NO: 77160 - DNA, 15 bp, Artificial Sequence
  dgRNA
  Gm17455
tcaaattcccaaggg

SEQ ID NO: 77161 - DNA, 15 bp, Artificial Sequence
  dgRNA
  Gm17455
tttccgcacatgaga

SEQ ID NO: 77162 - DNA, 15 bp, Artificial Sequence
  dgRNA
  Gm17455
gggttccaaggcgac

SEQ ID NO: 77163 - DNA, 15 bp, Artificial Sequence
  dgRNA
  Dnajc6
gcgaagagtacaaag

SEQ ID NO: 77164 - DNA, 15 bp, Artificial Sequence
  dgRNA
  Dnajc6
acaaagaggacgctc

SEQ ID NO: 77165 - DNA, 15 bp, Artificial Sequence
  dgRNA
  Dnajc6
gatggagcagtgtac

SEQ ID NO: 77166 - DNA, 15 bp, Artificial Sequence
  dgRNA
  Steap4
taccccgcttggcag

SEQ ID NO: 77167 - DNA, 15 bp, Artificial Sequence
  dgRNA
  Steap4
ctgcacaataagttc

SEQ ID NO: 77168 - DNA, 15 bp, Artificial Sequence
  dgRNA
  Steap4
ctgtgcgggattccc

SEQ ID NO: 77169 - DNA, 15 bp, Artificial Sequence
  dgRNA
  Steap4
aggttgaactcttcc

SEQ ID NO: 77170 - DNA, 15 bp, Artificial Sequence
  dgRNA
  Cttn
cgggtgtttctaaat

SEQ ID NO: 77171 - DNA, 15 bp, Artificial Sequence
  dgRNA
  Cttn
atctccgcagctgac

SEQ ID NO: 77172 - DNA, 15 bp, Artificial Sequence
  dgRNA
  Cttn
tccgcagctgactgg

SEQ ID NO: 77173 - DNA, 15 bp, Artificial Sequence
  dgRNA
  Cttn
tcttgatcagctaac

SEQ ID NO: 77174 - DNA, 15 bp, Artificial Sequence
  dgRNA
  Nab1
tccgcaccgcacctg

SEQ ID NO: 77175 - DNA, 15 bp, Artificial Sequence
  dgRNA
  Nab1
cctcctgggcgggcc

SEQ ID NO: 77176 - DNA, 15 bp, Artificial Sequence
  dgRNA
  Nab1
ggcgggcccggtgcg

SEQ ID NO: 77177 - DNA, 15 bp, Artificial Sequence
  dgRNA
  Nab1
gcccggtgcggggct

SEQ ID NO: 77178 - DNA, 15 bp, Artificial Sequence
  dgRNA
  Trim44
cgctttaagtgactc

SEQ ID NO: 77179 - DNA, 15 bp, Artificial Sequence
  dgRNA
  Trim44
aaaggaggccgctga

SEQ ID NO: 77180 - DNA, 15 bp, Artificial Sequence
  dgRNA
  Trim44
aggccgctgacggcg

SEQ ID NO: 77181 - DNA, 15 bp, Artificial Sequence
  dgRNA
  Trim44
ggccgctgacggcgt

SEQ ID NO: 77182 - DNA, 15 bp, Artificial Sequence
  dgRNA
  Mxra7
tttcagcgcctccca

SEQ ID NO: 77183 - DNA, 15 bp, Artificial Sequence
  dgRNA
  Mxra7
actccgaatcactcc

SEQ ID NO: 77184 - DNA, 15 bp, Artificial Sequence
  dgRNA
  Mxra7
ctccgaatcactcca

SEQ ID NO: 77185 - DNA, 15 bp, Artificial Sequence
  dgRNA
  Mxra7
tcactccagggcgcg

SEQ ID NO: 77186 - DNA, 15 bp, Artificial Sequence
  dgRNA
  Glb1
tctggcagccgggac

SEQ ID NO: 77187 - DNA, 15 bp, Artificial Sequence
  dgRNA
  Glb1
gccgggacaggctga

SEQ ID NO: 77188 - DNA, 15 bp, Artificial Sequence
  dgRNA
  Glb1
catcattgctcattc

SEQ ID NO: 77189 - DNA, 15 bp, Artificial Sequence
  dgRNA
  Glb1
ggggtgccgccattc

SEQ ID NO: 77190 - DNA, 15 bp, Artificial Sequence
  dgRNA
  Aida
cctgacaagcttacc

SEQ ID NO: 77191 - DNA, 15 bp, Artificial Sequence
  dgRNA
  Aida
ctgacaagcttaccg

SEQ ID NO: 77192 - DNA, 15 bp, Artificial Sequence
  dgRNA
  Aida
acctcagagtccgta

SEQ ID NO: 77193 - DNA, 15 bp, Artificial Sequence
  dgRNA
  Aida
tcctccagcgagaca

SEQ ID NO: 77194 - DNA, 15 bp, Artificial Sequence
  dgRNA
  Kcnd1
cagatgacacgactg

SEQ ID NO: 77195 - DNA, 15 bp, Artificial Sequence
  dgRNA
  Kcnd1
ggcggagtttcccca

SEQ ID NO: 77196 - DNA, 15 bp, Artificial Sequence
  dgRNA
  Kcnd1
ccgacaagctccaga

SEQ ID NO: 77197 - DNA, 15 bp, Artificial Sequence
  dgRNA
  Kcnd1
cgacaagctccagag

SEQ ID NO: 77198 - DNA, 15 bp, Artificial Sequence
  dgRNA
  Nptn
cgctgcggcggtagg

SEQ ID NO: 77199 - DNA, 15 bp, Artificial Sequence
  dgRNA
  Nptn
tgcggcggtaggagg

SEQ ID NO: 77200 - DNA, 15 bp, Artificial Sequence
  dgRNA
  Nptn
cggtaggaggaggac

SEQ ID NO: 77201 - DNA, 15 bp, Artificial Sequence
  dgRNA
  Nptn
gacggagctcggccg

SEQ ID NO: 77202 - DNA, 15 bp, Artificial Sequence
  dgRNA
  Asz1
gaagtaccacggaag

SEQ ID NO: 77203 - DNA, 15 bp, Artificial Sequence
  dgRNA
  Asz1
agatgtgaccccatc

SEQ ID NO: 77204 - DNA, 15 bp, Artificial Sequence
  dgRNA
  Asz1
gaccccatcaggttc

SEQ ID NO: 77205 - DNA, 15 bp, Artificial Sequence
  dgRNA
  Asz1
aggttccggtgtgaa

SEQ ID NO: 77206 - DNA, 15 bp, Artificial Sequence
  dgRNA
  Kcnk12
gcggccagaacgacc

SEQ ID NO: 77207 - DNA, 15 bp, Artificial Sequence
  dgRNA
  Kcnk12
cccaacactccgccc

SEQ ID NO: 77208 - DNA, 15 bp, Artificial Sequence
  dgRNA
  Kcnk12
ccaacactccgcccc

SEQ ID NO: 77209 - DNA, 15 bp, Artificial Sequence
  dgRNA
  Kcnk12
actccgccccgggct

SEQ ID NO: 77210 - DNA, 15 bp, Artificial Sequence
  dgRNA
  Naga
cagcggcgcgcgcac

SEQ ID NO: 77211 - DNA, 15 bp, Artificial Sequence
  dgRNA
  Naga
agcggcgcgcgcaca

SEQ ID NO: 77212 - DNA, 15 bp, Artificial Sequence
  dgRNA
  Naga
caagccgacttccca

SEQ ID NO: 77213 - DNA, 15 bp, Artificial Sequence
  dgRNA
  Naga
aagccgacttcccac

SEQ ID NO: 77214 - DNA, 15 bp, Artificial Sequence
  dgRNA
  Ptp4a2
cagcaagccacgcgg

SEQ ID NO: 77215 - DNA, 15 bp, Artificial Sequence
  dgRNA
  Ptp4a2
caagccacgcggagg

SEQ ID NO: 77216 - DNA, 15 bp, Artificial Sequence
  dgRNA
  Ptp4a2
cgcgggaggcgccca

SEQ ID NO: 77217 - DNA, 15 bp, Artificial Sequence
  dgRNA
  Ptp4a2
ggcgcccagggcagt

SEQ ID NO: 77218 - DNA, 15 bp, Artificial Sequence
  dgRNA
  Epb41
ttattcaggatgggt

SEQ ID NO: 77219 - DNA, 15 bp, Artificial Sequence
  dgRNA
  Hoxc10
ccgtctgaatcatca

SEQ ID NO: 77220 - DNA, 15 bp, Artificial Sequence
  dgRNA
  Hoxc10
ggtctagccgtcaca

SEQ ID NO: 77221 - DNA, 15 bp, Artificial Sequence
  dgRNA
  Hoxc10
agccgtcacatggtg

SEQ ID NO: 77222 - DNA, 15 bp, Artificial Sequence
  dgRNA
  Hoxc10
tgaggaccgaatgcg

SEQ ID NO: 77223 - DNA, 15 bp, Artificial Sequence
  dgRNA
  D5Ertd579e
acgagggcggagccc

SEQ ID NO: 77224 - DNA, 15 bp, Artificial Sequence
  dgRNA
  D5Ertd579e
gcgctgatgtaatcc

SEQ ID NO: 77225 - DNA, 15 bp, Artificial Sequence
  dgRNA
  D5Ertd579e
cggcgcctgggcgga

SEQ ID NO: 77226 - DNA, 15 bp, Artificial Sequence
  dgRNA
  D5Ertd579e
ctgggcggaaggata

SEQ ID NO: 77227 - DNA, 15 bp, Artificial Sequence
  dgRNA
  1700012B07Rik
tagatcctgactctg

SEQ ID NO: 77228 - DNA, 15 bp, Artificial Sequence
  dgRNA
  Ankra2
gagcggtatgctgta

SEQ ID NO: 77229 - DNA, 15 bp, Artificial Sequence
  dgRNA
  Ankra2
agagcggtatgctgt

SEQ ID NO: 77230 - DNA, 15 bp, Artificial Sequence
  dgRNA
  Smap1
cgtcagacgcttctc

SEQ ID NO: 77231 - DNA, 15 bp, Artificial Sequence
  dgRNA
  Smap1
gagtctcccggcacg

SEQ ID NO: 77232 - DNA, 15 bp, Artificial Sequence
  dgRNA
  Smap1
agtctcccggcacgc

SEQ ID NO: 77233 - DNA, 15 bp, Artificial Sequence
  dgRNA
  Smap1
cggcacgcgggcagc

SEQ ID NO: 77234 - DNA, 15 bp, Artificial Sequence
  dgRNA
  Susd3
ggccctagagtccaa

SEQ ID NO: 77235 - DNA, 15 bp, Artificial Sequence
  dgRNA
  Susd3
agtccaaaggtgagt

SEQ ID NO: 77236 - DNA, 15 bp, Artificial Sequence
  dgRNA
  Susd3
acggctctagctcaa

SEQ ID NO: 77237 - DNA, 15 bp, Artificial Sequence
  dgRNA
  Susd3
caaaggcttacttcg

SEQ ID NO: 77238 - DNA, 15 bp, Artificial Sequence
  dgRNA
  Pou3f2
atccacgtaaatcaa

SEQ ID NO: 77239 - DNA, 15 bp, Artificial Sequence
  dgRNA
  Pou3f2
tccacgtaaatcaaa

SEQ ID NO: 77240 - DNA, 15 bp, Artificial Sequence
  dgRNA
  Pou3f2
gggcgcagagccaat

SEQ ID NO: 77241 - DNA, 15 bp, Artificial Sequence
  dgRNA
  Pou3f2
cgcagagccaatggg

SEQ ID NO: 77242 - DNA, 15 bp, Artificial Sequence
  dgRNA
  Trdmt1
gccctgctagccccc

SEQ ID NO: 77243 - DNA, 15 bp, Artificial Sequence
  dgRNA
  Trdmt1
ttaatctgcagctag

SEQ ID NO: 77244 - DNA, 15 bp, Artificial Sequence
  dgRNA
  Trdmt1
ggaactgaaaagccg

SEQ ID NO: 77245 - DNA, 15 bp, Artificial Sequence
  dgRNA
  Trdmt1
cggaaccagaagcga

SEQ ID NO: 77246 - DNA, 15 bp, Artificial Sequence
  dgRNA
  S100a5
ccctccaaccttgtc

SEQ ID NO: 77247 - DNA, 15 bp, Artificial Sequence
  dgRNA
  S100a5
gggtactggggacga

SEQ ID NO: 77248 - DNA, 15 bp, Artificial Sequence
  dgRNA
  S100a5
gaataaaggcactag

SEQ ID NO: 77249 - DNA, 15 bp, Artificial Sequence
  dgRNA
  S100a5
aataaaggcactagt

SEQ ID NO: 77250 - DNA, 15 bp, Artificial Sequence
  dgRNA
  Ube2s
tgcgcgtctttctcc

SEQ ID NO: 77251 - DNA, 15 bp, Artificial Sequence
  dgRNA
  Ube2s
gcgcaccccaagtcg

SEQ ID NO: 77252 - DNA, 15 bp, Artificial Sequence
  dgRNA
  Ube2s
caccccaagtcgtgg

SEQ ID NO: 77253 - DNA, 15 bp, Artificial Sequence
  dgRNA
  Ube2s
ggcgtctcattcaaa

SEQ ID NO: 77254 - DNA, 15 bp, Artificial Sequence
  dgRNA
  Nceh1
gcagcttggcatcgc

SEQ ID NO: 77255 - DNA, 15 bp, Artificial Sequence
  dgRNA
  Nceh1
ctcacagtgtccgcc

SEQ ID NO: 77256 - DNA, 15 bp, Artificial Sequence
  dgRNA
  Nceh1
tcacagtgtccgcca

SEQ ID NO: 77257 - DNA, 15 bp, Artificial Sequence
  dgRNA
  Nceh1
cacagtgtccgccag

SEQ ID NO: 77258 - DNA, 15 bp, Artificial Sequence
  dgRNA
  Defa-rs1
aaggtactcattgat

SEQ ID NO: 77259 - DNA, 15 bp, Artificial Sequence
  dgRNA
  Uckl1
tggcccggagtggtg

SEQ ID NO: 77260 - DNA, 15 bp, Artificial Sequence
  dgRNA
  Uckl1
cccggagtggtgcgg

SEQ ID NO: 77261 - DNA, 15 bp, Artificial Sequence
  dgRNA
  Uckl1
gagtggtgcggtggt

SEQ ID NO: 77262 - DNA, 15 bp, Artificial Sequence
  dgRNA
  Uckl1
gcaaaggtcattctc

SEQ ID NO: 77263 - DNA, 15 bp, Artificial Sequence
  dgRNA
  Lce3a
cctggttccacatta

SEQ ID NO: 77264 - DNA, 15 bp, Artificial Sequence
  dgRNA
  Lce3a
ctggttccacattaa

SEQ ID NO: 77265 - DNA, 15 bp, Artificial Sequence
  dgRNA
  Lce3a
cattaagggatcttt

SEQ ID NO: 77266 - DNA, 15 bp, Artificial Sequence
  dgRNA
  Lce3a
tttaggcacgtgtac

SEQ ID NO: 77267 - DNA, 15 bp, Artificial Sequence
  dgRNA
  Mrap
gtaagtcaaggacgc

SEQ ID NO: 77268 - DNA, 15 bp, Artificial Sequence
  dgRNA
  Mrap
gtcaaggacgctggc

SEQ ID NO: 77269 - DNA, 15 bp, Artificial Sequence
  dgRNA
  Mrap
catccttccacggag

SEQ ID NO: 77270 - DNA, 15 bp, Artificial Sequence
  dgRNA
  Mrap
caagctagagccgaa

SEQ ID NO: 77271 - DNA, 15 bp, Artificial Sequence
  dgRNA
  Crebl2
gcgctgctaggccac

SEQ ID NO: 77272 - DNA, 15 bp, Artificial Sequence
  dgRNA
  Crebl2
gcagcggaggctaca

SEQ ID NO: 77273 - DNA, 15 bp, Artificial Sequence
  dgRNA
  Crebl2
cttagagaacacgca

SEQ ID NO: 77274 - DNA, 15 bp, Artificial Sequence
  dgRNA
  Crebl2
aatgccactgtacta

SEQ ID NO: 77275 - DNA, 15 bp, Artificial Sequence
  dgRNA
  Gsdma
cggggcacttcaaac

SEQ ID NO: 77276 - DNA, 15 bp, Artificial Sequence
  dgRNA
  Gsdma
acatccccgcctcca

SEQ ID NO: 77277 - DNA, 15 bp, Artificial Sequence
  dgRNA
  Gsdma
tccccgcctccatgg

SEQ ID NO: 77278 - DNA, 15 bp, Artificial Sequence
  dgRNA
  Gsdma
gggtaaaaagatgcc

SEQ ID NO: 77279 - DNA, 15 bp, Artificial Sequence
  dgRNA
  Smim7
gcaatttctgtagcc

SEQ ID NO: 77280 - DNA, 15 bp, Artificial Sequence
  dgRNA
  Smim7
caaccaacccccgag

SEQ ID NO: 77281 - DNA, 15 bp, Artificial Sequence
  dgRNA
  Smim7
agcggcatcaacagc

SEQ ID NO: 77282 - DNA, 15 bp, Artificial Sequence
  dgRNA
  Smim7
gcggcatcaacagca

SEQ ID NO: 77283 - DNA, 15 bp, Artificial Sequence
  dgRNA
  Ssmem1
aacctcggtcgcaga

SEQ ID NO: 77284 - DNA, 15 bp, Artificial Sequence
  dgRNA
  Ssmem1
catcaactctcttag

SEQ ID NO: 77285 - DNA, 15 bp, Artificial Sequence
  dgRNA
  Ssmem1
tcataattggttgcc

SEQ ID NO: 77286 - DNA, 15 bp, Artificial Sequence
  dgRNA
  Ssmem1
cataattggttgcca

SEQ ID NO: 77287 - DNA, 15 bp, Artificial Sequence
  dgRNA
  Trim31
taacaagccttcctg

SEQ ID NO: 77288 - DNA, 15 bp, Artificial Sequence
  dgRNA
  Trim31
ccaattacacctgag

SEQ ID NO: 77289 - DNA, 15 bp, Artificial Sequence
  dgRNA
  Trim31
attagttcaaggtcc

SEQ ID NO: 77290 - DNA, 15 bp, Artificial Sequence
  dgRNA
  Trim31
atcgctggcagcccc

SEQ ID NO: 77291 - DNA, 15 bp, Artificial Sequence
  dgRNA
  Vmn2r93
gcattcccaatccgc

SEQ ID NO: 77292 - DNA, 15 bp, Artificial Sequence
  dgRNA
  Vmn2r93
gattgggaatgcaat

SEQ ID NO: 77293 - DNA, 15 bp, Artificial Sequence
  dgRNA
  Vmn2r93
tcattccagcggatt

SEQ ID NO: 77294 - DNA, 15 bp, Artificial Sequence
  dgRNA
  Vmn2r93
atcattccagcggat

SEQ ID NO: 77295 - DNA, 15 bp, Artificial Sequence
  dgRNA
  Zfp513
gcgctgttcgccttc

SEQ ID NO: 77296 - DNA, 15 bp, Artificial Sequence
  dgRNA
  Zfp513
ttcctagttcgtata

SEQ ID NO: 77297 - DNA, 15 bp, Artificial Sequence
  dgRNA
  Zfp513
ctagttcgtatatgg

SEQ ID NO: 77298 - DNA, 15 bp, Artificial Sequence
  dgRNA
  Zfp513
tagttcgtatatgga

SEQ ID NO: 77299 - DNA, 15 bp, Artificial Sequence
  dgRNA
  Mrpl54
catcaccatttgaac

SEQ ID NO: 77300 - DNA, 15 bp, Artificial Sequence
  dgRNA
  Mrpl54
atcaccatttgaact

SEQ ID NO: 77301 - DNA, 15 bp, Artificial Sequence
  dgRNA
  Mrpl54
caccatttgaactgg

SEQ ID NO: 77302 - DNA, 15 bp, Artificial Sequence
  dgRNA
  Mrpl54
aaattagtcgttagt

SEQ ID NO: 77303 - DNA, 15 bp, Artificial Sequence
  dgRNA
  Slc25a30
gagcagcccgcagct

SEQ ID NO: 77304 - DNA, 15 bp, Artificial Sequence
  dgRNA
  Slc25a30
gggacccgctcttcc

SEQ ID NO: 77305 - DNA, 15 bp, Artificial Sequence
  dgRNA
  Slc25a30
ggacccgctcttcct

SEQ ID NO: 77306 - DNA, 15 bp, Artificial Sequence
  dgRNA
  Slc25a30
tgaccaatgagaacg

SEQ ID NO: 77307 - DNA, 15 bp, Artificial Sequence
  dgRNA
  Cerkl
gttgccttggcagcg

SEQ ID NO: 77308 - DNA, 15 bp, Artificial Sequence
  dgRNA
  Cerkl
ttgccttggcagcgt

SEQ ID NO: 77309 - DNA, 15 bp, Artificial Sequence
  dgRNA
  Cerkl
cgtgggacaaggccc

SEQ ID NO: 77310 - DNA, 15 bp, Artificial Sequence
  dgRNA
  Cerkl
tcccacgaagatttc

SEQ ID NO: 77311 - DNA, 15 bp, Artificial Sequence
  dgRNA
  Zfp747
cacgtgatacaaccc

SEQ ID NO: 77312 - DNA, 15 bp, Artificial Sequence
  dgRNA
  Zfp747
acgtgatacaaccct

SEQ ID NO: 77313 - DNA, 15 bp, Artificial Sequence
  dgRNA
  Zfp747
gatacaaccctgggc

SEQ ID NO: 77314 - DNA, 15 bp, Artificial Sequence
  dgRNA
  Zfp747
gcaccacaaacaggg

SEQ ID NO: 77315 - DNA, 15 bp, Artificial Sequence
  dgRNA
  Psmd9
gaaacggacggatgg

SEQ ID NO: 77316 - DNA, 15 bp, Artificial Sequence
  dgRNA
  Psmd9
acggatggagggacg

SEQ ID NO: 77317 - DNA, 15 bp, Artificial Sequence
  dgRNA
  Psmd9
catctgaaaaccacg

SEQ ID NO: 77318 - DNA, 15 bp, Artificial Sequence
  dgRNA
  Psmd9
cgtggtctatctagc

SEQ ID NO: 77319 - DNA, 15 bp, Artificial Sequence
  dgRNA
  Tnfsf13b
ttcgataagcttgtc

SEQ ID NO: 77320 - DNA, 15 bp, Artificial Sequence
  dgRNA
  Tnfsf13b
cagccgccgtgtcag

SEQ ID NO: 77321 - DNA, 15 bp, Artificial Sequence
  dgRNA
  Tnfsf13b
agacaagcttatcga

SEQ ID NO: 77322 - DNA, 15 bp, Artificial Sequence
  dgRNA
  Tnfsf13b
gacacggcggctggg

SEQ ID NO: 77323 - DNA, 15 bp, Artificial Sequence
  dgRNA
  Mrps15
agaaagtgattaggc

SEQ ID NO: 77324 - DNA, 15 bp, Artificial Sequence
  dgRNA
  Mrps15
attaggccggatgca

SEQ ID NO: 77325 - DNA, 15 bp, Artificial Sequence
  dgRNA
  Mrps15
ggatgcaaggtcaat

SEQ ID NO: 77326 - DNA, 15 bp, Artificial Sequence
  dgRNA
  Mrps15
tgtaagcgtagaaac

SEQ ID NO: 77327 - DNA, 15 bp, Artificial Sequence
  dgRNA
  Prl8a6
tctgctcgattatat

SEQ ID NO: 77328 - DNA, 15 bp, Artificial Sequence
  dgRNA
  Prl8a6
cgattatataggaac

SEQ ID NO: 77329 - DNA, 15 bp, Artificial Sequence
  dgRNA
  Prl8a6
agcagataacctcaa

SEQ ID NO: 77330 - DNA, 15 bp, Artificial Sequence
  dgRNA
  Tgif2
tgactccgggagccc

SEQ ID NO: 77331 - DNA, 15 bp, Artificial Sequence
  dgRNA
  Tgif2
ccggagtcagctcca

SEQ ID NO: 77332 - DNA, 15 bp, Artificial Sequence
  dgRNA
  Tgif2
cccggagtcagctcc

SEQ ID NO: 77333 - DNA, 15 bp, Artificial Sequence
  dgRNA
  Gpr17
tgatactcagtggcc

SEQ ID NO: 77334 - DNA, 15 bp, Artificial Sequence
  dgRNA
  Gpr17
ggcacgcaccatctg

SEQ ID NO: 77335 - DNA, 15 bp, Artificial Sequence
  dgRNA
  Gpr17
tcaggacgtgctccg

SEQ ID NO: 77336 - DNA, 15 bp, Artificial Sequence
  dgRNA
  Gpr17
cacaaaggacccctc

SEQ ID NO: 77337 - DNA, 15 bp, Artificial Sequence
  dgRNA
  Trim59
atccccgccctcgcg

SEQ ID NO: 77338 - DNA, 15 bp, Artificial Sequence
  dgRNA
  Trim59
gccctcgcgaggtcc

SEQ ID NO: 77339 - DNA, 15 bp, Artificial Sequence
  dgRNA
  Trim59
cgcgcgctagtgcgc

SEQ ID NO: 77340 - DNA, 15 bp, Artificial Sequence
  dgRNA
  Trim59
ctggccctcggccgt

SEQ ID NO: 77341 - DNA, 15 bp, Artificial Sequence
  dgRNA
  Ywhah
caccctccaacgctg

SEQ ID NO: 77342 - DNA, 15 bp, Artificial Sequence
  dgRNA
  Ywhah
cctccaacgctgcgg

SEQ ID NO: 77343 - DNA, 15 bp, Artificial Sequence
  dgRNA
  Ywhah
actgcagtactccta

SEQ ID NO: 77344 - DNA, 15 bp, Artificial Sequence
  dgRNA
  Ywhah
cgcagctctccagcg

SEQ ID NO: 77345 - DNA, 15 bp, Artificial Sequence
  dgRNA
  Mycl
ctcccgcgtcgatcc

SEQ ID NO: 77346 - DNA, 15 bp, Artificial Sequence
  dgRNA
  Mycl
tcccgcgtcgatccc

SEQ ID NO: 77347 - DNA, 15 bp, Artificial Sequence
  dgRNA
  Mycl
atcccgggagcgtcc

SEQ ID NO: 77348 - DNA, 15 bp, Artificial Sequence
  dgRNA
  Mycl
tgccgtgtgcgagcg

SEQ ID NO: 77349 - DNA, 15 bp, Artificial Sequence
  dgRNA
  Esd
ggagagtgcgcgccc

SEQ ID NO: 77350 - DNA, 15 bp, Artificial Sequence
  dgRNA
  Esd
gagagtgcgcgccct

SEQ ID NO: 77351 - DNA, 15 bp, Artificial Sequence
  dgRNA
  Esd
agagtgcgcgccctg

SEQ ID NO: 77352 - DNA, 15 bp, Artificial Sequence
  dgRNA
  Esd
gagtgcgcgccctgg

SEQ ID NO: 77353 - DNA, 15 bp, Artificial Sequence
  dgRNA
  Wipf1
gctgtgcgctcccag

SEQ ID NO: 77354 - DNA, 15 bp, Artificial Sequence
  dgRNA
  Wipf1
ctgtgcgctcccagt

SEQ ID NO: 77355 - DNA, 15 bp, Artificial Sequence
  dgRNA
  Wipf1
tgcgctcccagtggg

SEQ ID NO: 77356 - DNA, 15 bp, Artificial Sequence
  dgRNA
  Wipf1
gcgctcccagtgggc

SEQ ID NO: 77357 - DNA, 15 bp, Artificial Sequence
  dgRNA
  Loxhd1
agcgggacagaactt

SEQ ID NO: 77358 - DNA, 15 bp, Artificial Sequence
  dgRNA
  Loxhd1
gcgggacagaacttt

SEQ ID NO: 77359 - DNA, 15 bp, Artificial Sequence
  dgRNA
  Loxhd1
acctgaaaccctagt

SEQ ID NO: 77360 - DNA, 15 bp, Artificial Sequence
  dgRNA
  Loxhd1
tgaaaccctagtggg

SEQ ID NO: 77361 - DNA, 15 bp, Artificial Sequence
  dgRNA
  H2-M10.4
acaactggtgccaag

SEQ ID NO: 77362 - DNA, 15 bp, Artificial Sequence
  dgRNA
  H2-M10.4
aagacccgccccatc

SEQ ID NO: 77363 - DNA, 15 bp, Artificial Sequence
  dgRNA
  H2-M10.4
tacagctttgtatcc

SEQ ID NO: 77364 - DNA, 15 bp, Artificial Sequence
  dgRNA
  H2-M10.4
tgatggggcgggtct

SEQ ID NO: 77365 - DNA, 15 bp, Artificial Sequence
  dgRNA
  Chmp2a
ctgtgctcccgccat

SEQ ID NO: 77366 - DNA, 15 bp, Artificial Sequence
  dgRNA
  Chmp2a
cgccatgggcctgtg

SEQ ID NO: 77367 - DNA, 15 bp, Artificial Sequence
  dgRNA
  Chmp2a
ttctgctgaggtgcg

SEQ ID NO: 77368 - DNA, 15 bp, Artificial Sequence
  dgRNA
  Chmp2a
gcgcatgcgcttctg

SEQ ID NO: 77369 - DNA, 15 bp, Artificial Sequence
  dgRNA
  Ppil4
ttatatgggtcacca

SEQ ID NO: 77370 - DNA, 15 bp, Artificial Sequence
  dgRNA
  Ppil4
tatatgggtcaccaa

SEQ ID NO: 77371 - DNA, 15 bp, Artificial Sequence
  dgRNA
  Ppil4
ccgggccgaacgagc

SEQ ID NO: 77372 - DNA, 15 bp, Artificial Sequence
  dgRNA
  Ppil4
aacgagccggccatt

SEQ ID NO: 77373 - DNA, 15 bp, Artificial Sequence
  dgRNA
  Ggt1
ccgcttagactgtcc

SEQ ID NO: 77374 - DNA, 15 bp, Artificial Sequence
  dgRNA
  Ggt1
gctcgggtttcttct

SEQ ID NO: 77375 - DNA, 15 bp, Artificial Sequence
  dgRNA
  Ggt1
ctcgggtttcttctc

SEQ ID NO: 77376 - DNA, 15 bp, Artificial Sequence
  dgRNA
  Ggt1
tcgggtttcttctcg

SEQ ID NO: 77377 - DNA, 15 bp, Artificial Sequence
  dgRNA
  Ing5
catccgcgttccctc

SEQ ID NO: 77378 - DNA, 15 bp, Artificial Sequence
  dgRNA
  Ing5
atccgcgttccctca

SEQ ID NO: 77379 - DNA, 15 bp, Artificial Sequence
  dgRNA
  Ing5
ccccacagcgccgcc

SEQ ID NO: 77380 - DNA, 15 bp, Artificial Sequence
  dgRNA
  Ing5
cctggcgaccacagc

SEQ ID NO: 77381 - DNA, 15 bp, Artificial Sequence
  dgRNA
  Rps5
tagctagtacttcag

SEQ ID NO: 77382 - DNA, 15 bp, Artificial Sequence
  dgRNA
  Rps5
ggtccgccagaagac

SEQ ID NO: 77383 - DNA, 15 bp, Artificial Sequence
  dgRNA
  Rps5
gccagaagacgggcg

SEQ ID NO: 77384 - DNA, 15 bp, Artificial Sequence
  dgRNA
  Rps5
tgcgcatgctttacc

SEQ ID NO: 77385 - DNA, 15 bp, Artificial Sequence
  dgRNA
  Capn12
aagtcagtcgatgaa

SEQ ID NO: 77386 - DNA, 15 bp, Artificial Sequence
  dgRNA
  Capn12
gtcgatgaagggcct

SEQ ID NO: 77387 - DNA, 15 bp, Artificial Sequence
  dgRNA
  Capn12
cttgcctgccacatc

SEQ ID NO: 77388 - DNA, 15 bp, Artificial Sequence
  dgRNA
  Capn12
gcctgccacatcggg

SEQ ID NO: 77389 - DNA, 15 bp, Artificial Sequence
  dgRNA
  Tmem246
caaacgcttccgcaa

SEQ ID NO: 77390 - DNA, 15 bp, Artificial Sequence
  dgRNA
  Tmem246
aaacgcttccgcaaa

SEQ ID NO: 77391 - DNA, 15 bp, Artificial Sequence
  dgRNA
  Tmem246
tcgctgcccatcagt

SEQ ID NO: 77392 - DNA, 15 bp, Artificial Sequence
  dgRNA
  Tmem246
gcatctcgccctttg

SEQ ID NO: 77393 - DNA, 15 bp, Artificial Sequence
  dgRNA
  Mbd5
gacaggtaccagcat

SEQ ID NO: 77394 - DNA, 15 bp, Artificial Sequence
  dgRNA
  Mbd5
ataattcacctatgc

SEQ ID NO: 77395 - DNA, 15 bp, Artificial Sequence
  dgRNA
  Mbd5
aacttgggctcagtt

SEQ ID NO: 77396 - DNA, 15 bp, Artificial Sequence
  dgRNA
  Tbx3
atgcagccacacaat

SEQ ID NO: 77397 - DNA, 15 bp, Artificial Sequence
  dgRNA
  Tbx3
agcccacagcgctgc

SEQ ID NO: 77398 - DNA, 15 bp, Artificial Sequence
  dgRNA
  Tbx3
gaaggtgtcggaaac

SEQ ID NO: 77399 - DNA, 15 bp, Artificial Sequence
  dgRNA
  Tbx3
cgagttataaaaaga

SEQ ID NO: 77400 - DNA, 15 bp, Artificial Sequence
  dgRNA
  Vmn1r13
ccataatttacatgc

SEQ ID NO: 77401 - DNA, 15 bp, Artificial Sequence
  dgRNA
  Vmn1r13
ccagcatgtaaatta

SEQ ID NO: 77402 - DNA, 15 bp, Artificial Sequence
  dgRNA
  Gga1
ttaacctcatcgcgt

SEQ ID NO: 77403 - DNA, 15 bp, Artificial Sequence
  dgRNA
  Gga1
acctcatcgcgttgg

SEQ ID NO: 77404 - DNA, 15 bp, Artificial Sequence
  dgRNA
  Gga1
tcatcgcgttggcgg

SEQ ID NO: 77405 - DNA, 15 bp, Artificial Sequence
  dgRNA
  Gga1
ccagttgccctttta

SEQ ID NO: 77406 - DNA, 15 bp, Artificial Sequence
  dgRNA
  Mx2
gccaaggccccctta

SEQ ID NO: 77407 - DNA, 15 bp, Artificial Sequence
  dgRNA
  Mx2
agctccattcatgtg

SEQ ID NO: 77408 - DNA, 15 bp, Artificial Sequence
  dgRNA
  Mx2
ccattcatgtgtggt

SEQ ID NO: 77409 - DNA, 15 bp, Artificial Sequence
  dgRNA
  Mx2
aagacacgtgcagta

SEQ ID NO: 77410 - DNA, 15 bp, Artificial Sequence
  dgRNA
  Kcnab3
tgaccggaatgaaag

SEQ ID NO: 77411 - DNA, 15 bp, Artificial Sequence
  dgRNA
  Kcnab3
accccgttcctaaaa

SEQ ID NO: 77412 - DNA, 15 bp, Artificial Sequence
  dgRNA
  Kcnab3
ccccgttcctaaaac

SEQ ID NO: 77413 - DNA, 15 bp, Artificial Sequence
  dgRNA
  Kcnab3
taaaacgggatgttc

SEQ ID NO: 77414 - DNA, 15 bp, Artificial Sequence
  dgRNA
  Ncapg
aacaccttttcctat

SEQ ID NO: 77415 - DNA, 15 bp, Artificial Sequence
  dgRNA
  Ncapg
acaccttttcctatt

SEQ ID NO: 77416 - DNA, 15 bp, Artificial Sequence
  dgRNA
  Ncapg
tattgggagagcggc

SEQ ID NO: 77417 - DNA, 15 bp, Artificial Sequence
  dgRNA
  Ncapg
caggcgtcccagcag

SEQ ID NO: 77418 - DNA, 15 bp, Artificial Sequence
  dgRNA
  Cnot11
gcccccttccggaca

SEQ ID NO: 77419 - DNA, 15 bp, Artificial Sequence
  dgRNA
  Cnot11
gcccactcgcgtctc

SEQ ID NO: 77420 - DNA, 15 bp, Artificial Sequence
  dgRNA
  Cnot11
tccggaacctccgct

SEQ ID NO: 77421 - DNA, 15 bp, Artificial Sequence
  dgRNA
  Cnot11
ctcggccagcgtcgt

SEQ ID NO: 77422 - DNA, 15 bp, Artificial Sequence
  dgRNA
  Fam35a
gcctcgcctccgccg

SEQ ID NO: 77423 - DNA, 15 bp, Artificial Sequence
  dgRNA
  Fam35a
cgccgcggccttgcc

SEQ ID NO: 77424 - DNA, 15 bp, Artificial Sequence
  dgRNA
  Fam35a
ccggcctccaggcgg

SEQ ID NO: 77425 - DNA, 15 bp, Artificial Sequence
  dgRNA
  Fam35a
cggcgcgtgcggctg

SEQ ID NO: 77426 - DNA, 15 bp, Artificial Sequence
  dgRNA
  C1qtnf4
cggtgggtaacgctc

SEQ ID NO: 77427 - DNA, 15 bp, Artificial Sequence
  dgRNA
  C1qtnf4
taacgctcaggatcc

SEQ ID NO: 77428 - DNA, 15 bp, Artificial Sequence
  dgRNA
  C1qtnf4
agcgcaggctcggtg

SEQ ID NO: 77429 - DNA, 15 bp, Artificial Sequence
  dgRNA
  C1qtnf4
tcggtgcggtgcccc

SEQ ID NO: 77430 - DNA, 15 bp, Artificial Sequence
  dgRNA
  Scap
cctctcgcagttgtg

SEQ ID NO: 77431 - DNA, 15 bp, Artificial Sequence
  dgRNA
  Scap
tcgcagttgtgtggc

SEQ ID NO: 77432 - DNA, 15 bp, Artificial Sequence
  dgRNA
  Scap
cgcagttgtgtggca

SEQ ID NO: 77433 - DNA, 15 bp, Artificial Sequence
  dgRNA
  Scap
tggcaggggaccacc

SEQ ID NO: 77434 - DNA, 15 bp, Artificial Sequence
  dgRNA
  Fbxw2
atgacgcagcagcac

SEQ ID NO: 77435 - DNA, 15 bp, Artificial Sequence
  dgRNA
  Fbxw2
agccgctcccctgtg

SEQ ID NO: 77436 - DNA, 15 bp, Artificial Sequence
  dgRNA
  Fbxw2
caggggagcggcttc

SEQ ID NO: 77437 - DNA, 15 bp, Artificial Sequence
  dgRNA
  Haao
aggcgggtctgttct

SEQ ID NO: 77438 - DNA, 15 bp, Artificial Sequence
  dgRNA
  Haao
ggcgggtctgttctt

SEQ ID NO: 77439 - DNA, 15 bp, Artificial Sequence
  dgRNA
  Haao
ccggcgtgtgtgcag

SEQ ID NO: 77440 - DNA, 15 bp, Artificial Sequence
  dgRNA
  Haao
gtaacctaattaact

SEQ ID NO: 77441 - DNA, 15 bp, Artificial Sequence
  dgRNA
  Gm9758
ggctatgccccagaa

SEQ ID NO: 77442 - DNA, 15 bp, Artificial Sequence
  dgRNA
  Pot1b
aatccattaggggcg

SEQ ID NO: 77443 - DNA, 15 bp, Artificial Sequence
  dgRNA
  Pot1b
taggggcgtggaaag

SEQ ID NO: 77444 - DNA, 15 bp, Artificial Sequence
  dgRNA
  Pot1b
agcacgagcaaaaag

SEQ ID NO: 77445 - DNA, 15 bp, Artificial Sequence
  dgRNA
  Pot1b
gcacgagcaaaaagc

SEQ ID NO: 77446 - DNA, 15 bp, Artificial Sequence
  dgRNA
  H2-Oa
cccagcatagccatt

SEQ ID NO: 77447 - DNA, 15 bp, Artificial Sequence
  dgRNA
  H2-Oa
aagccccttcttgaa

SEQ ID NO: 77448 - DNA, 15 bp, Artificial Sequence
  dgRNA
  H2-Oa
ccaaatggctatgct

SEQ ID NO: 77449 - DNA, 15 bp, Artificial Sequence
  dgRNA
  H2-Oa
accaaatggctatgc

SEQ ID NO: 77450 - DNA, 15 bp, Artificial Sequence
  dgRNA
  Fstl5
ccaagagccccatat

SEQ ID NO: 77451 - DNA, 15 bp, Artificial Sequence
  dgRNA
  Fstl5
tctgatgcatgagac

SEQ ID NO: 77452 - DNA, 15 bp, Artificial Sequence
  dgRNA
  Fstl5
ccctagcgggctgtg

SEQ ID NO: 77453 - DNA, 15 bp, Artificial Sequence
  dgRNA
  Fstl5
cctatatggggctct

SEQ ID NO: 77454 - DNA, 15 bp, Artificial Sequence
  dgRNA
  Sema3d
ggtttgctcgctctg

SEQ ID NO: 77455 - DNA, 15 bp, Artificial Sequence
  dgRNA
  Sema3d
gtttgctcgctctga

SEQ ID NO: 77456 - DNA, 15 bp, Artificial Sequence
  dgRNA
  Sema3d
acatcagaagtggcc

SEQ ID NO: 77457 - DNA, 15 bp, Artificial Sequence
  dgRNA
  Sema3d
gaagtggccgggagc

SEQ ID NO: 77458 - DNA, 15 bp, Artificial Sequence
  dgRNA
  Frmd4b
ggcgagctgcaaccg

SEQ ID NO: 77459 - DNA, 15 bp, Artificial Sequence
  dgRNA
  Frmd4b
gcgagctgcaaccgc

SEQ ID NO: 77460 - DNA, 15 bp, Artificial Sequence
  dgRNA
  Frmd4b
cgagctgcaaccgcg

SEQ ID NO: 77461 - DNA, 15 bp, Artificial Sequence
  dgRNA
  Frmd4b
tcccgatacaatgac

SEQ ID NO: 77462 - DNA, 15 bp, Artificial Sequence
  dgRNA
  Rdm1
gcactggagctaatg

SEQ ID NO: 77463 - DNA, 15 bp, Artificial Sequence
  dgRNA
  Rdm1
cactggagctaatgt

SEQ ID NO: 77464 - DNA, 15 bp, Artificial Sequence
  dgRNA
  Rdm1
cgccctttacttgtg

SEQ ID NO: 77465 - DNA, 15 bp, Artificial Sequence
  dgRNA
  Rdm1
gccctttacttgtga

SEQ ID NO: 77466 - DNA, 15 bp, Artificial Sequence
  dgRNA
  Tmem45a2
aggttatctgagccc

SEQ ID NO: 77467 - DNA, 15 bp, Artificial Sequence
  dgRNA
  Tmem45a2
atggcattaatttgt

SEQ ID NO: 77468 - DNA, 15 bp, Artificial Sequence
  dgRNA
  Tmem45a2
attaatttgtgggcc

SEQ ID NO: 77469 - DNA, 15 bp, Artificial Sequence
  dgRNA
  Tmem45a2
ggagttaaaacctcc

SEQ ID NO: 77470 - DNA, 15 bp, Artificial Sequence
  dgRNA
  Hmmr
tttgcggcgacgatc

SEQ ID NO: 77471 - DNA, 15 bp, Artificial Sequence
  dgRNA
  Hmmr
tacaaaccttccgat

SEQ ID NO: 77472 - DNA, 15 bp, Artificial Sequence
  dgRNA
  Hmmr
acaaaccttccgatt

SEQ ID NO: 77473 - DNA, 15 bp, Artificial Sequence
  dgRNA
  Hmmr
aaccttccgattggg

SEQ ID NO: 77474 - DNA, 15 bp, Artificial Sequence
  dgRNA
  Dnajc5
cggcttagtagctgc

SEQ ID NO: 77475 - DNA, 15 bp, Artificial Sequence
  dgRNA
  Dnajc5
cggaagctacagccc

SEQ ID NO: 77476 - DNA, 15 bp, Artificial Sequence
  dgRNA
  Dnajc5
ccggaagctacagcc

SEQ ID NO: 77477 - DNA, 15 bp, Artificial Sequence
  dgRNA
  Dnajc5
ctgcagctactaagc

SEQ ID NO: 77478 - DNA, 15 bp, Artificial Sequence
  dgRNA
  Ugt1a6b
gattaaggcaagccc

SEQ ID NO: 77479 - DNA, 15 bp, Artificial Sequence
  dgRNA
  Ugt1a6b
ttgagcctacatgcc

SEQ ID NO: 77480 - DNA, 15 bp, Artificial Sequence
  dgRNA
  Nppa
cggcaaagcttgtca

SEQ ID NO: 77481 - DNA, 15 bp, Artificial Sequence
  dgRNA
  Nppa
taaagcgatggagtg

SEQ ID NO: 77482 - DNA, 15 bp, Artificial Sequence
  dgRNA
  Nppa
gcagcgataaagcga

SEQ ID NO: 77483 - DNA, 15 bp, Artificial Sequence
  dgRNA
  Csrnp3
acttttgactccagc

SEQ ID NO: 77484 - DNA, 15 bp, Artificial Sequence
  dgRNA
  Csrnp3
tctaaaagctcgagg

SEQ ID NO: 77485 - DNA, 15 bp, Artificial Sequence
  dgRNA
  Csrnp3
ctaaaagctcgaggt

SEQ ID NO: 77486 - DNA, 15 bp, Artificial Sequence
  dgRNA
  Csrnp3
acctcgagcttttag

SEQ ID NO: 77487 - DNA, 15 bp, Artificial Sequence
  dgRNA
  Suv39h1
tacggagcctggagc

SEQ ID NO: 77488 - DNA, 15 bp, Artificial Sequence
  dgRNA
  Suv39h1
gctggaaggccggcg

SEQ ID NO: 77489 - DNA, 15 bp, Artificial Sequence
  dgRNA
  Suv39h1
ccggcgcggcaaacg

SEQ ID NO: 77490 - DNA, 15 bp, Artificial Sequence
  dgRNA
  Suv39h1
cggcgcggcaaacgt

SEQ ID NO: 77491 - DNA, 15 bp, Artificial Sequence
  dgRNA
  Npl
gcgcacaaccacctg

SEQ ID NO: 77492 - DNA, 15 bp, Artificial Sequence
  dgRNA
  Npl
attacaggccacagg

SEQ ID NO: 77493 - DNA, 15 bp, Artificial Sequence
  dgRNA
  Npl
tggattacaggccac

SEQ ID NO: 77494 - DNA, 15 bp, Artificial Sequence
  dgRNA
  Rgs14
catggtgtgcaaccg

SEQ ID NO: 77495 - DNA, 15 bp, Artificial Sequence
  dgRNA
  Rgs14
atggtgtgcaaccga

SEQ ID NO: 77496 - DNA, 15 bp, Artificial Sequence
  dgRNA
  Rgs14
caaccgagggtgcgt

SEQ ID NO: 77497 - DNA, 15 bp, Artificial Sequence
  dgRNA
  Rgs14
ccgagggtgcgttgg

SEQ ID NO: 77498 - DNA, 15 bp, Artificial Sequence
  dgRNA
  1700016C15Rik
tagtggttgatagtc

SEQ ID NO: 77499 - DNA, 15 bp, Artificial Sequence
  dgRNA
  1700016C15Rik
agtggttgatagtct

SEQ ID NO: 77500 - DNA, 15 bp, Artificial Sequence
  dgRNA
  1700016C15Rik
ggtcacttacctgta

SEQ ID NO: 77501 - DNA, 15 bp, Artificial Sequence
  dgRNA
  1700016C15Rik
agagacgttcaaaac

SEQ ID NO: 77502 - DNA, 15 bp, Artificial Sequence
  dgRNA
  Ubxn10
cggggtcatgtgcag

SEQ ID NO: 77503 - DNA, 15 bp, Artificial Sequence
  dgRNA
  Ubxn10
aagtgccctttaccc

SEQ ID NO: 77504 - DNA, 15 bp, Artificial Sequence
  dgRNA
  Ubxn10
gtagacgcccctccc

SEQ ID NO: 77505 - DNA, 15 bp, Artificial Sequence
  dgRNA
  Ubxn10
ttggatctgggtcca

SEQ ID NO: 77506 - DNA, 15 bp, Artificial Sequence
  dgRNA
  Golga1
cgcgcggcaaacgtg

SEQ ID NO: 77507 - DNA, 15 bp, Artificial Sequence
  dgRNA
  Golga1
gcaaacgtgcggttc

SEQ ID NO: 77508 - DNA, 15 bp, Artificial Sequence
  dgRNA
  Golga1
caaacgtgcggttcc

SEQ ID NO: 77509 - DNA, 15 bp, Artificial Sequence
  dgRNA
  Golga1
cgtgcggttccgggt

SEQ ID NO: 77510 - DNA, 15 bp, Artificial Sequence
  dgRNA
  Slc52a3
ccccgccctggtggc

SEQ ID NO: 77511 - DNA, 15 bp, Artificial Sequence
  dgRNA
  Slc52a3
ctgtccccgccctgg

SEQ ID NO: 77512 - DNA, 15 bp, Artificial Sequence
  dgRNA
  Slc52a3
tgtctgtccccgccc

SEQ ID NO: 77513 - DNA, 15 bp, Artificial Sequence
  dgRNA
  Rtp4
tccgcagtttcagca

SEQ ID NO: 77514 - DNA, 15 bp, Artificial Sequence
  dgRNA
  Rtp4
ggccctttaacacag

SEQ ID NO: 77515 - DNA, 15 bp, Artificial Sequence
  dgRNA
  Rtp4
cgatttgctgcccta

SEQ ID NO: 77516 - DNA, 15 bp, Artificial Sequence
  dgRNA
  Rtp4
tagcggctcctgtgt

SEQ ID NO: 77517 - DNA, 15 bp, Artificial Sequence
  dgRNA
  L3mbtl1
tccagcgcagcaagc

SEQ ID NO: 77518 - DNA, 15 bp, Artificial Sequence
  dgRNA
  L3mbtl1
agcaagcgggtttta

SEQ ID NO: 77519 - DNA, 15 bp, Artificial Sequence
  dgRNA
  L3mbtl1
gcaagcgggttttac

SEQ ID NO: 77520 - DNA, 15 bp, Artificial Sequence
  dgRNA
  L3mbtl1
gggttttacgggaag

SEQ ID NO: 77521 - DNA, 15 bp, Artificial Sequence
  dgRNA
  Sds
ctgacccccgggtcc

SEQ ID NO: 77522 - DNA, 15 bp, Artificial Sequence
  dgRNA
  Sds
ccccgggtccaggca

SEQ ID NO: 77523 - DNA, 15 bp, Artificial Sequence
  dgRNA
  Sds
cccgggtccaggcaa

SEQ ID NO: 77524 - DNA, 15 bp, Artificial Sequence
  dgRNA
  Sds
gcatgccctcctccg

SEQ ID NO: 77525 - DNA, 15 bp, Artificial Sequence
  dgRNA
  Kcnk4
cccaacccattcagc

SEQ ID NO: 77526 - DNA, 15 bp, Artificial Sequence
  dgRNA
  Kcnk4
cagctggttaaatcc

SEQ ID NO: 77527 - DNA, 15 bp, Artificial Sequence
  dgRNA
  Kcnk4
ctggttaaatccagg

SEQ ID NO: 77528 - DNA, 15 bp, Artificial Sequence
  dgRNA
  Kcnk4
gactatcctcatggg

SEQ ID NO: 77529 - DNA, 15 bp, Artificial Sequence
  dgRNA
  Pcolce2
gctggaagtccacta

SEQ ID NO: 77530 - DNA, 15 bp, Artificial Sequence
  dgRNA
  Pcolce2
tctttacttgcccct

SEQ ID NO: 77531 - DNA, 15 bp, Artificial Sequence
  dgRNA
  Pcolce2
ctttacttgcccctt

SEQ ID NO: 77532 - DNA, 15 bp, Artificial Sequence
  dgRNA
  Pcolce2
caccccggaaaacca

SEQ ID NO: 77533 - DNA, 15 bp, Artificial Sequence
  dgRNA
  Cacna1c
ccgacccgcgatctt

SEQ ID NO: 77534 - DNA, 15 bp, Artificial Sequence
  dgRNA
  Slc6a5
gattacagacgtgtc

SEQ ID NO: 77535 - DNA, 15 bp, Artificial Sequence
  dgRNA
  Slc6a5
gacgtgtctggcgag

SEQ ID NO: 77536 - DNA, 15 bp, Artificial Sequence
  dgRNA
  Slc6a5
cgagtggagaaacac

SEQ ID NO: 77537 - DNA, 15 bp, Artificial Sequence
  dgRNA
  Slc6a5
ggtagcaaacggaac

SEQ ID NO: 77538 - DNA, 15 bp, Artificial Sequence
  dgRNA
  Fam213b
tacctgctacgccat

SEQ ID NO: 77539 - DNA, 15 bp, Artificial Sequence
  dgRNA
  Fam213b
gaacaacctaggctt

SEQ ID NO: 77540 - DNA, 15 bp, Artificial Sequence
  dgRNA
  Fam213b
ctgtatactaatatc

SEQ ID NO: 77541 - DNA, 15 bp, Artificial Sequence
  dgRNA
  Fam213b
gtatactaatatcag

SEQ ID NO: 77542 - DNA, 15 bp, Artificial Sequence
  dgRNA
  Hs3st6
agctcctggtcgctc

SEQ ID NO: 77543 - DNA, 15 bp, Artificial Sequence
  dgRNA
  Hs3st6
gctctggaagttagc

SEQ ID NO: 77544 - DNA, 15 bp, Artificial Sequence
  dgRNA
  Hs3st6
ggagtcgctagtccc

SEQ ID NO: 77545 - DNA, 15 bp, Artificial Sequence
  dgRNA
  Hs3st6
cgctagtcccaggcg

SEQ ID NO: 77546 - DNA, 15 bp, Artificial Sequence
  dgRNA
  Olfr452
gataaagttgcagat

SEQ ID NO: 77547 - DNA, 15 bp, Artificial Sequence
  dgRNA
  Olfr452
cactccagtatctta

SEQ ID NO: 77548 - DNA, 15 bp, Artificial Sequence
  dgRNA
  Ccdc66
caaggcggctcccca

SEQ ID NO: 77549 - DNA, 15 bp, Artificial Sequence
  dgRNA
  Ccdc66
gcggctccccaaggt

SEQ ID NO: 77550 - DNA, 15 bp, Artificial Sequence
  dgRNA
  Ccdc66
gctccccaaggttgg

SEQ ID NO: 77551 - DNA, 15 bp, Artificial Sequence
  dgRNA
  Ccdc66
aaccgcagacgcccc

SEQ ID NO: 77552 - DNA, 15 bp, Artificial Sequence
  dgRNA
  Sh3glb2
gacgcgcgcgcgcag

SEQ ID NO: 77553 - DNA, 15 bp, Artificial Sequence
  dgRNA
  Sh3glb2
cgcgcgcgcagaggg

SEQ ID NO: 77554 - DNA, 15 bp, Artificial Sequence
  dgRNA
  Sh3glb2
gcgcgcgcagagggc

SEQ ID NO: 77555 - DNA, 15 bp, Artificial Sequence
  dgRNA
  Sh3glb2
gcgggcgcaggcagc

SEQ ID NO: 77556 - DNA, 15 bp, Artificial Sequence
  dgRNA
  Vmn2r16
tagaatgtacttaag

SEQ ID NO: 77557 - DNA, 15 bp, Artificial Sequence
  dgRNA
  Vmn2r16
ctgtgccatgcaacc

SEQ ID NO: 77558 - DNA, 15 bp, Artificial Sequence
  dgRNA
  B4galt7
acgtgctttctctgc

SEQ ID NO: 77559 - DNA, 15 bp, Artificial Sequence
  dgRNA
  B4galt7
tgctgggctgaccgt

SEQ ID NO: 77560 - DNA, 15 bp, Artificial Sequence
  dgRNA
  B4galt7
ataccagccttcact

SEQ ID NO: 77561 - DNA, 15 bp, Artificial Sequence
  dgRNA
  B4galt7
accagccttcacttg

SEQ ID NO: 77562 - DNA, 15 bp, Artificial Sequence
  dgRNA
  Nckap1
ctgccgcgttctccc

SEQ ID NO: 77563 - DNA, 15 bp, Artificial Sequence
  dgRNA
  Nckap1
ctggagcgtctgtca

SEQ ID NO: 77564 - DNA, 15 bp, Artificial Sequence
  dgRNA
  Nckap1
gcgtctgtcaaggcg

SEQ ID NO: 77565 - DNA, 15 bp, Artificial Sequence
  dgRNA
  Nckap1
cgtctgtcaaggcgt

SEQ ID NO: 77566 - DNA, 15 bp, Artificial Sequence
  dgRNA
  Ackr2
tattggactgctctt

SEQ ID NO: 77567 - DNA, 15 bp, Artificial Sequence
  dgRNA
  Ackr2
attggactgctcttg

SEQ ID NO: 77568 - DNA, 15 bp, Artificial Sequence
  dgRNA
  Ackr2
gctcagtgcagcgga

SEQ ID NO: 77569 - DNA, 15 bp, Artificial Sequence
  dgRNA
  Ackr2
ctcagtgcagcggat

SEQ ID NO: 77570 - DNA, 15 bp, Artificial Sequence
  dgRNA
  9430069I07Rik
catacacttactata

SEQ ID NO: 77571 - DNA, 15 bp, Artificial Sequence
  dgRNA
  9430069I07Rik
tggttaattcccgaa

SEQ ID NO: 77572 - DNA, 15 bp, Artificial Sequence
  dgRNA
  9430069I07Rik
aattcccgaaaggcc

SEQ ID NO: 77573 - DNA, 15 bp, Artificial Sequence
  dgRNA
  9430069I07Rik
attcccgaaaggcca

SEQ ID NO: 77574 - DNA, 15 bp, Artificial Sequence
  dgRNA
  6430531B16Rik
attcagcccgatctc

SEQ ID NO: 77575 - DNA, 15 bp, Artificial Sequence
  dgRNA
  6430531B16Rik
ttcagcccgatctct

SEQ ID NO: 77576 - DNA, 15 bp, Artificial Sequence
  dgRNA
  6430531B16Rik
ctctgggcgtgcagg

SEQ ID NO: 77577 - DNA, 15 bp, Artificial Sequence
  dgRNA
  6430531B16Rik
aggaccaatccttcc

SEQ ID NO: 77578 - DNA, 15 bp, Artificial Sequence
  dgRNA
  Nlrp5
tctctactccacacg

SEQ ID NO: 77579 - DNA, 15 bp, Artificial Sequence
  dgRNA
  Nol8
gtcagttttacaacg

SEQ ID NO: 77580 - DNA, 15 bp, Artificial Sequence
  dgRNA
  Nol8
agttttacaacgtgg

SEQ ID NO: 77581 - DNA, 15 bp, Artificial Sequence
  dgRNA
  Nol8
cgtcagtaaaagcga

SEQ ID NO: 77582 - DNA, 15 bp, Artificial Sequence
  dgRNA
  Nol8
cagtaaaagcgaagg

SEQ ID NO: 77583 - DNA, 15 bp, Artificial Sequence
  dgRNA
  Zfp711
tctccttatcccaat

SEQ ID NO: 77584 - DNA, 15 bp, Artificial Sequence
  dgRNA
  Zfp711
ccacggaaactcctc

SEQ ID NO: 77585 - DNA, 15 bp, Artificial Sequence
  dgRNA
  Zfp711
cacggaaactcctca

SEQ ID NO: 77586 - DNA, 15 bp, Artificial Sequence
  dgRNA
  Zfp711
gggacgtcccaagat

SEQ ID NO: 77587 - DNA, 15 bp, Artificial Sequence
  dgRNA
  Reg2
catgatgtccgagaa

SEQ ID NO: 77588 - DNA, 15 bp, Artificial Sequence
  dgRNA
  Reg2
taccattacgtagcc

SEQ ID NO: 77589 - DNA, 15 bp, Artificial Sequence
  dgRNA
  Reg2
tttctcggacatcat

SEQ ID NO: 77590 - DNA, 15 bp, Artificial Sequence
  dgRNA
  Reg2
ctttctcggacatca

SEQ ID NO: 77591 - DNA, 15 bp, Artificial Sequence
  dgRNA
  Lonp1
catcacgtgcgcaaa

SEQ ID NO: 77592 - DNA, 15 bp, Artificial Sequence
  dgRNA
  Lonp1
atcacgtgcgcaaac

SEQ ID NO: 77593 - DNA, 15 bp, Artificial Sequence
  dgRNA
  Lonp1
tcacgtgcgcaaacg

SEQ ID NO: 77594 - DNA, 15 bp, Artificial Sequence
  dgRNA
  Lonp1
cacgtgcgcaaacgg

SEQ ID NO: 77595 - DNA, 15 bp, Artificial Sequence
  dgRNA
  Hspa8
ctctcaggcagcccg

SEQ ID NO: 77596 - DNA, 15 bp, Artificial Sequence
  dgRNA
  Hspa8
gcccggggtcccaag

SEQ ID NO: 77597 - DNA, 15 bp, Artificial Sequence
  dgRNA
  Hspa8
gaacgctgctctcat

SEQ ID NO: 77598 - DNA, 15 bp, Artificial Sequence
  dgRNA
  Hspa8
ctcattggtccgtcg

SEQ ID NO: 77599 - DNA, 15 bp, Artificial Sequence
  dgRNA
  Mark4
aggcctgtaccttta

SEQ ID NO: 77600 - DNA, 15 bp, Artificial Sequence
  dgRNA
  Mark4
tgtacctttaagggc

SEQ ID NO: 77601 - DNA, 15 bp, Artificial Sequence
  dgRNA
  Mark4
acctttaagggccgg

SEQ ID NO: 77602 - DNA, 15 bp, Artificial Sequence
  dgRNA
  Mark4
ttaagggccggcggc

SEQ ID NO: 77603 - DNA, 15 bp, Artificial Sequence
  dgRNA
  6030419C18Rik
agccccgccgtgctg

SEQ ID NO: 77604 - DNA, 15 bp, Artificial Sequence
  dgRNA
  6030419C18Rik
gctgtgctcgacacc

SEQ ID NO: 77605 - DNA, 15 bp, Artificial Sequence
  dgRNA
  6030419C18Rik
gacaccgggtccccc

SEQ ID NO: 77606 - DNA, 15 bp, Artificial Sequence
  dgRNA
  6030419C18Rik
tcccccgagacgcga

SEQ ID NO: 77607 - DNA, 15 bp, Artificial Sequence
  dgRNA
  Pcdhb14
tgccatacgagactt

SEQ ID NO: 77608 - DNA, 15 bp, Artificial Sequence
  dgRNA
  Pcdhb14
cgagacttaggtgaa

SEQ ID NO: 77609 - DNA, 15 bp, Artificial Sequence
  dgRNA
  Pcdhb14
ctttgacctaaaaag

SEQ ID NO: 77610 - DNA, 15 bp, Artificial Sequence
  dgRNA
  Pcdhb14
gtaaaacagaacgct

SEQ ID NO: 77611 - DNA, 15 bp, Artificial Sequence
  dgRNA
  Lins1
acactgtactacgaa

SEQ ID NO: 77612 - DNA, 15 bp, Artificial Sequence
  dgRNA
  Lins1
cactgtactacgaat

SEQ ID NO: 77613 - DNA, 15 bp, Artificial Sequence
  dgRNA
  Lins1
actgtactacgaatg

SEQ ID NO: 77614 - DNA, 15 bp, Artificial Sequence
  dgRNA
  Lins1
cttctacgcctgctg

SEQ ID NO: 77615 - DNA, 15 bp, Artificial Sequence
  dgRNA
  Rce1
acgcccagcaagcca

SEQ ID NO: 77616 - DNA, 15 bp, Artificial Sequence
  dgRNA
  Rce1
atcaactatcgtgca

SEQ ID NO: 77617 - DNA, 15 bp, Artificial Sequence
  dgRNA
  Rce1
tcaactatcgtgcaa

SEQ ID NO: 77618 - DNA, 15 bp, Artificial Sequence
  dgRNA
  Rce1
caactatcgtgcaag

SEQ ID NO: 77619 - DNA, 15 bp, Artificial Sequence
  dgRNA
  Izumo1r
ttgccacccacttca

SEQ ID NO: 77620 - DNA, 15 bp, Artificial Sequence
  dgRNA
  BC068281
cagttgagacctgcg

SEQ ID NO: 77621 - DNA, 15 bp, Artificial Sequence
  dgRNA
  BC068281
agttgagacctgcgt

SEQ ID NO: 77622 - DNA, 15 bp, Artificial Sequence
  dgRNA
  BC068281
gtgaagattttcggg

SEQ ID NO: 77623 - DNA, 15 bp, Artificial Sequence
  dgRNA
  BC068281
cgggcggtgatttcg

SEQ ID NO: 77624 - DNA, 15 bp, Artificial Sequence
  dgRNA
  Socs6
tcgcacccacgaccg

SEQ ID NO: 77625 - DNA, 15 bp, Artificial Sequence
  dgRNA
  Socs6
cgcacccacgaccgc

SEQ ID NO: 77626 - DNA, 15 bp, Artificial Sequence
  dgRNA
  Socs6
cgacgccccgcctac

SEQ ID NO: 77627 - DNA, 15 bp, Artificial Sequence
  dgRNA
  Socs6
gacgccccgcctacc

SEQ ID NO: 77628 - DNA, 15 bp, Artificial Sequence
  dgRNA
  Gabrg2
aaaaggaccgaccct

SEQ ID NO: 77629 - DNA, 15 bp, Artificial Sequence
  dgRNA
  Gabrg2
aaaggaccgaccctt

SEQ ID NO: 77630 - DNA, 15 bp, Artificial Sequence
  dgRNA
  Gabrg2
tcctgttagtgcacc

SEQ ID NO: 77631 - DNA, 15 bp, Artificial Sequence
  dgRNA
  Gabrg2
ttatcctctcagact

SEQ ID NO: 77632 - DNA, 15 bp, Artificial Sequence
  dgRNA
  Olfr748
gaaaaagactaactt

SEQ ID NO: 77633 - DNA, 15 bp, Artificial Sequence
  dgRNA
  Olfr748
taactttggagccaa

SEQ ID NO: 77634 - DNA, 15 bp, Artificial Sequence
  dgRNA
  Lmod3
ctcaagttgccaaaa

SEQ ID NO: 77635 - DNA, 15 bp, Artificial Sequence
  dgRNA
  Lmod3
ctatggaatctctgc

SEQ ID NO: 77636 - DNA, 15 bp, Artificial Sequence
  dgRNA
  Lmod3
cgagtagccgggcta

SEQ ID NO: 77637 - DNA, 15 bp, Artificial Sequence
  dgRNA
  Lmod3
agacagcgagtagcc

SEQ ID NO: 77638 - DNA, 15 bp, Artificial Sequence
  dgRNA
  Atad2b
agagcgcctccccgc

SEQ ID NO: 77639 - DNA, 15 bp, Artificial Sequence
  dgRNA
  Atad2b
gctgacgtcacgtcg

SEQ ID NO: 77640 - DNA, 15 bp, Artificial Sequence
  dgRNA
  Atad2b
gacgtcacgtcgagg

SEQ ID NO: 77641 - DNA, 15 bp, Artificial Sequence
  dgRNA
  Atad2b
acgtcacgtcgaggc

SEQ ID NO: 77642 - DNA, 15 bp, Artificial Sequence
  dgRNA
  Ppia
aacggaggcgctcac

SEQ ID NO: 77643 - DNA, 15 bp, Artificial Sequence
  dgRNA
  Ppia
acggaggcgctcaca

SEQ ID NO: 77644 - DNA, 15 bp, Artificial Sequence
  dgRNA
  Ppia
gccattgcacaatga

SEQ ID NO: 77645 - DNA, 15 bp, Artificial Sequence
  dgRNA
  Ppia
tgcacaatgacggtg

SEQ ID NO: 77646 - DNA, 15 bp, Artificial Sequence
  dgRNA
  Mms22l
gcttcagcggagagc

SEQ ID NO: 77647 - DNA, 15 bp, Artificial Sequence
  dgRNA
  Mms22l
ctcgcaaactctcaa

SEQ ID NO: 77648 - DNA, 15 bp, Artificial Sequence
  dgRNA
  Mms22l
aaactctcaacggta

SEQ ID NO: 77649 - DNA, 15 bp, Artificial Sequence
  dgRNA
  Mms22l
tgaagagcgaatccc

SEQ ID NO: 77650 - DNA, 15 bp, Artificial Sequence
  dgRNA
  Aldh3a1
catgaactccatgcc

SEQ ID NO: 77651 - DNA, 15 bp, Artificial Sequence
  dgRNA
  Aldh3a1
ggctggattactcag

SEQ ID NO: 77652 - DNA, 15 bp, Artificial Sequence
  dgRNA
  Aldh3a1
gtggcccccacgccc

SEQ ID NO: 77653 - DNA, 15 bp, Artificial Sequence
  dgRNA
  Aldh3a1
tggcccccacgccca

SEQ ID NO: 77654 - DNA, 15 bp, Artificial Sequence
  dgRNA
  Azi2
acgtacgccccgccg

SEQ ID NO: 77655 - DNA, 15 bp, Artificial Sequence
  dgRNA
  Azi2
tacgccccgccgcgg

SEQ ID NO: 77656 - DNA, 15 bp, Artificial Sequence
  dgRNA
  Azi2
cgccgcggaggctca

SEQ ID NO: 77657 - DNA, 15 bp, Artificial Sequence
  dgRNA
  Azi2
gccgcggaggctcac

SEQ ID NO: 77658 - DNA, 15 bp, Artificial Sequence
  dgRNA
  Rfx4
accacaaggtacctc

SEQ ID NO: 77659 - DNA, 15 bp, Artificial Sequence
  dgRNA
  Rfx4
tgcccacagacggaa

SEQ ID NO: 77660 - DNA, 15 bp, Artificial Sequence
  dgRNA
  Rfx4
gtttcttataactta

SEQ ID NO: 77661 - DNA, 15 bp, Artificial Sequence
  dgRNA
  Rfx4
agaggtaccttgtgg

SEQ ID NO: 77662 - DNA, 15 bp, Artificial Sequence
  dgRNA
  Insm1
cggctccgcgccccc

SEQ ID NO: 77663 - DNA, 15 bp, Artificial Sequence
  dgRNA
  Insm1
ctccgcgccccccgg

SEQ ID NO: 77664 - DNA, 15 bp, Artificial Sequence
  dgRNA
  Insm1
tgcgcctccccatag

SEQ ID NO: 77665 - DNA, 15 bp, Artificial Sequence
  dgRNA
  Insm1
agcagcagaccgtga

SEQ ID NO: 77666 - DNA, 15 bp, Artificial Sequence
  dgRNA
  Lipk
gaggcccagtactta

SEQ ID NO: 77667 - DNA, 15 bp, Artificial Sequence
  dgRNA
  Lipk
acttaaggtctgatt

SEQ ID NO: 77668 - DNA, 15 bp, Artificial Sequence
  dgRNA
  Lipk
cagaccttaagtact

SEQ ID NO: 77669 - DNA, 15 bp, Artificial Sequence
  dgRNA
  Lipk
tcagaccttaagtac

SEQ ID NO: 77670 - DNA, 15 bp, Artificial Sequence
  dgRNA
  Cpeb2
ctccattcaaggtcc

SEQ ID NO: 77671 - DNA, 15 bp, Artificial Sequence
  dgRNA
  Cpeb2
cgcccgctgcctcgc

SEQ ID NO: 77672 - DNA, 15 bp, Artificial Sequence
  dgRNA
  Cpeb2
gcccgctgcctcgca

SEQ ID NO: 77673 - DNA, 15 bp, Artificial Sequence
  dgRNA
  Cpeb2
caacgcacgctaatg

SEQ ID NO: 77674 - DNA, 15 bp, Artificial Sequence
  dgRNA
  Prkar2a
aaggtttttgtgacc

SEQ ID NO: 77675 - DNA, 15 bp, Artificial Sequence
  dgRNA
  Prkar2a
agcccgcctcgcagc

SEQ ID NO: 77676 - DNA, 15 bp, Artificial Sequence
  dgRNA
  Prkar2a
gcccgcctcgcagcc

SEQ ID NO: 77677 - DNA, 15 bp, Artificial Sequence
  dgRNA
  Prkar2a
cccgcaccttgacca

SEQ ID NO: 77678 - DNA, 15 bp, Artificial Sequence
  dgRNA
  Taar8a
aaggatttataaccg

SEQ ID NO: 77679 - DNA, 15 bp, Artificial Sequence
  dgRNA
  Nsg1
ggcatgcatccctag

SEQ ID NO: 77680 - DNA, 15 bp, Artificial Sequence
  dgRNA
  Nsg1
gcatgcatccctagt

SEQ ID NO: 77681 - DNA, 15 bp, Artificial Sequence
  dgRNA
  Nsg1
cactaagagccaccg

SEQ ID NO: 77682 - DNA, 15 bp, Artificial Sequence
  dgRNA
  Nsg1
gcatgcctagagtgt

SEQ ID NO: 77683 - DNA, 15 bp, Artificial Sequence
  dgRNA
  Iqsec2
gagacaagttgtttg

SEQ ID NO: 77684 - DNA, 15 bp, Artificial Sequence
  dgRNA
  Iqsec2
tttccaattgcatcc

SEQ ID NO: 77685 - DNA, 15 bp, Artificial Sequence
  dgRNA
  Iqsec2
ggaattcctaacaag

SEQ ID NO: 77686 - DNA, 15 bp, Artificial Sequence
  dgRNA
  Scml2
gttgtggggcatgcg

SEQ ID NO: 77687 - DNA, 15 bp, Artificial Sequence
  dgRNA
  Scml2
gcgcggctctgcgcg

SEQ ID NO: 77688 - DNA, 15 bp, Artificial Sequence
  dgRNA
  Ero1l
taccccgaccccgga

SEQ ID NO: 77689 - DNA, 15 bp, Artificial Sequence
  dgRNA
  Ero1l
accgcgtctttgcgc

SEQ ID NO: 77690 - DNA, 15 bp, Artificial Sequence
  dgRNA
  Ero1l
cgccggacgagctgc

SEQ ID NO: 77691 - DNA, 15 bp, Artificial Sequence
  dgRNA
  Ero1l
gacgagctgcaggcc

SEQ ID NO: 77692 - DNA, 15 bp, Artificial Sequence
  dgRNA
  4933406M09Rik
ctcacctcatcaagg

SEQ ID NO: 77693 - DNA, 15 bp, Artificial Sequence
  dgRNA
  4933406M09Rik
gaggtgtttgatgta

SEQ ID NO: 77694 - DNA, 15 bp, Artificial Sequence
  dgRNA
  4933406M09Rik
tgtttgatgtaaggc

SEQ ID NO: 77695 - DNA, 15 bp, Artificial Sequence
  dgRNA
  4933406M09Rik
aggctggttgacaca

SEQ ID NO: 77696 - DNA, 15 bp, Artificial Sequence
  dgRNA
  Bhmt
actgtgcttgttaga

SEQ ID NO: 77697 - DNA, 15 bp, Artificial Sequence
  dgRNA
  Bhmt
tgttagatggtgcca

SEQ ID NO: 77698 - DNA, 15 bp, Artificial Sequence
  dgRNA
  Bhmt
cactacttggaggat

SEQ ID NO: 77699 - DNA, 15 bp, Artificial Sequence
  dgRNA
  Bhmt
tgagcgcttctgcaa

SEQ ID NO: 77700 - DNA, 15 bp, Artificial Sequence
  dgRNA
  Acin1
ccccatccgcacaca

SEQ ID NO: 77701 - DNA, 15 bp, Artificial Sequence
  dgRNA
  Acin1
cccatccgcacacac

SEQ ID NO: 77702 - DNA, 15 bp, Artificial Sequence
  dgRNA
  Acin1
cgtgtgtgcggatgg

SEQ ID NO: 77703 - DNA, 15 bp, Artificial Sequence
  dgRNA
  Acin1
ccgtgtgtgcggatg

SEQ ID NO: 77704 - DNA, 15 bp, Artificial Sequence
  dgRNA
  Ets2
gtcggcgctgagact

SEQ ID NO: 77705 - DNA, 15 bp, Artificial Sequence
  dgRNA
  Ets2
actcggctcagccct

SEQ ID NO: 77706 - DNA, 15 bp, Artificial Sequence
  dgRNA
  Ets2
ctcggctcagcccta

SEQ ID NO: 77707 - DNA, 15 bp, Artificial Sequence
  dgRNA
  Ets2
tcggctcagccctag

SEQ ID NO: 77708 - DNA, 15 bp, Artificial Sequence
  dgRNA
  Wbp4
cgccccgtgcgctcc

SEQ ID NO: 77709 - DNA, 15 bp, Artificial Sequence
  dgRNA
  Wbp4
cgtgcgctcccggaa

SEQ ID NO: 77710 - DNA, 15 bp, Artificial Sequence
  dgRNA
  Wbp4
gtgcgctcccggaac

SEQ ID NO: 77711 - DNA, 15 bp, Artificial Sequence
  dgRNA
  Wbp4
cgctcccggaacggg

SEQ ID NO: 77712 - DNA, 15 bp, Artificial Sequence
  dgRNA
  Zcchc5
tgcaacttttcacaa

SEQ ID NO: 77713 - DNA, 15 bp, Artificial Sequence
  dgRNA
  Zcchc5
tagctcggaactgtg

SEQ ID NO: 77714 - DNA, 15 bp, Artificial Sequence
  dgRNA
  Zcchc5
tctgaatgaccgcag

SEQ ID NO: 77715 - DNA, 15 bp, Artificial Sequence
  dgRNA
  Zcchc5
cgtgcactcagtcct

SEQ ID NO: 77716 - DNA, 15 bp, Artificial Sequence
  dgRNA
  Stard3
taaccaagacaccct

SEQ ID NO: 77717 - DNA, 15 bp, Artificial Sequence
  dgRNA
  Stard3
gtttaacttcggttg

SEQ ID NO: 77718 - DNA, 15 bp, Artificial Sequence
  dgRNA
  Stard3
cctcgtctccgagag

SEQ ID NO: 77719 - DNA, 15 bp, Artificial Sequence
  dgRNA
  Stard3
ctcgtctccgagaga

SEQ ID NO: 77720 - DNA, 15 bp, Artificial Sequence
  dgRNA
  Acadl
gccctgcagccggga

SEQ ID NO: 77721 - DNA, 15 bp, Artificial Sequence
  dgRNA
  Acadl
aggggagggcgcacg

SEQ ID NO: 77722 - DNA, 15 bp, Artificial Sequence
  dgRNA
  Acadl
gcgtcgcgcagagcc

SEQ ID NO: 77723 - DNA, 15 bp, Artificial Sequence
  dgRNA
  Acadl
agaccccgcccgagc

SEQ ID NO: 77724 - DNA, 15 bp, Artificial Sequence
  dgRNA
  Bcap31
tgtccgaagtgtcag

SEQ ID NO: 77725 - DNA, 15 bp, Artificial Sequence
  dgRNA
  Bcap31
tgtcagaggcgcggc

SEQ ID NO: 77726 - DNA, 15 bp, Artificial Sequence
  dgRNA
  Bcap31
gtcagaggcgcggca

SEQ ID NO: 77727 - DNA, 15 bp, Artificial Sequence
  dgRNA
  Bcap31
tcagaggcgcggcag

SEQ ID NO: 77728 - DNA, 15 bp, Artificial Sequence
  dgRNA
  Micu1
attttgcaaatctgc

SEQ ID NO: 77729 - DNA, 15 bp, Artificial Sequence
  dgRNA
  Micu1
tttaggcgggaatgc

SEQ ID NO: 77730 - DNA, 15 bp, Artificial Sequence
  dgRNA
  Fam96b
accacggtctacatt

SEQ ID NO: 77731 - DNA, 15 bp, Artificial Sequence
  dgRNA
  Fam96b
gccgattcctactag

SEQ ID NO: 77732 - DNA, 15 bp, Artificial Sequence
  dgRNA
  Fam96b
gtgtcattagatcta

SEQ ID NO: 77733 - DNA, 15 bp, Artificial Sequence
  dgRNA
  Fam96b
agcgtgacagcgagc

SEQ ID NO: 77734 - DNA, 15 bp, Artificial Sequence
  dgRNA
  Ndst4
ctgccgggttatgat

SEQ ID NO: 77735 - DNA, 15 bp, Artificial Sequence
  dgRNA
  Fam73b
gccttccccatccag

SEQ ID NO: 77736 - DNA, 15 bp, Artificial Sequence
  dgRNA
  Fam73b
ccccatccagcggcg

SEQ ID NO: 77737 - DNA, 15 bp, Artificial Sequence
  dgRNA
  Fam73b
tccagcggcgtggtt

SEQ ID NO: 77738 - DNA, 15 bp, Artificial Sequence
  dgRNA
  Fam73b
ggttgtattgccgcc

SEQ ID NO: 77739 - DNA, 15 bp, Artificial Sequence
  dgRNA
  R3hdm2
gtttgatgtattctc

SEQ ID NO: 77740 - DNA, 15 bp, Artificial Sequence
  dgRNA
  R3hdm2
tgccactgttaattt

SEQ ID NO: 77741 - DNA, 15 bp, Artificial Sequence
  dgRNA
  R3hdm2
gccactgttaatttt

SEQ ID NO: 77742 - DNA, 15 bp, Artificial Sequence
  dgRNA
  R3hdm2
ctggagatgcgacaa

SEQ ID NO: 77743 - DNA, 15 bp, Artificial Sequence
  dgRNA
  Entpd8
ttacttgactccatc

SEQ ID NO: 77744 - DNA, 15 bp, Artificial Sequence
  dgRNA
  Entpd8
aaggtccacagtaag

SEQ ID NO: 77745 - DNA, 15 bp, Artificial Sequence
  dgRNA
  Entpd8
tccacagtaagcggg

SEQ ID NO: 77746 - DNA, 15 bp, Artificial Sequence
  dgRNA
  Entpd8
ccacagtaagcggga

SEQ ID NO: 77747 - DNA, 15 bp, Artificial Sequence
  dgRNA
  Tnfaip1
ccctgcggtgcttgc

SEQ ID NO: 77748 - DNA, 15 bp, Artificial Sequence
  dgRNA
  Tnfaip1
cctgcggtgcttgct

SEQ ID NO: 77749 - DNA, 15 bp, Artificial Sequence
  dgRNA
  Tnfaip1
cgataactgcccact

SEQ ID NO: 77750 - DNA, 15 bp, Artificial Sequence
  dgRNA
  Tnfaip1
tttgctcagggggcg

SEQ ID NO: 77751 - DNA, 15 bp, Artificial Sequence
  dgRNA
  Bri3bp
tttcaaacgcttgca

SEQ ID NO: 77752 - DNA, 15 bp, Artificial Sequence
  dgRNA
  Bri3bp
acgcttgcaaggatc

SEQ ID NO: 77753 - DNA, 15 bp, Artificial Sequence
  dgRNA
  Bri3bp
gatccggccccgatc

SEQ ID NO: 77754 - DNA, 15 bp, Artificial Sequence
  dgRNA
  Bri3bp
atactatcagcttca

SEQ ID NO: 77755 - DNA, 15 bp, Artificial Sequence
  dgRNA
  Plpp7
tgccctggtcaaagc

SEQ ID NO: 77756 - DNA, 15 bp, Artificial Sequence
  dgRNA
  Plpp7
ggtcaaagtgtagct

SEQ ID NO: 77757 - DNA, 15 bp, Artificial Sequence
  dgRNA
  Plpp7
agtccatctctgcta

SEQ ID NO: 77758 - DNA, 15 bp, Artificial Sequence
  dgRNA
  Plpp7
tgaccagctttgacc

SEQ ID NO: 77759 - DNA, 15 bp, Artificial Sequence
  dgRNA
  Rpl39l
aatctcaagctccta

SEQ ID NO: 77760 - DNA, 15 bp, Artificial Sequence
  dgRNA
  Rpl39l
agactagcaagcgca

SEQ ID NO: 77761 - DNA, 15 bp, Artificial Sequence
  dgRNA
  Rpl39l
agaatttgccgtacc

SEQ ID NO: 77762 - DNA, 15 bp, Artificial Sequence
  dgRNA
  Rpl39l
cgtacccggaagcgc

SEQ ID NO: 77763 - DNA, 15 bp, Artificial Sequence
  dgRNA
  Gdf1
tactgactccgcccc

SEQ ID NO: 77764 - DNA, 15 bp, Artificial Sequence
  dgRNA
  Gdf1
actcgacccagtccc

SEQ ID NO: 77765 - DNA, 15 bp, Artificial Sequence
  dgRNA
  Gdf1
cgacccagtccctgg

SEQ ID NO: 77766 - DNA, 15 bp, Artificial Sequence
  dgRNA
  Gdf1
gcccggtcccgcctt

SEQ ID NO: 77767 - DNA, 15 bp, Artificial Sequence
  dgRNA
  Grpel2
ctcgaggatgaggcg

SEQ ID NO: 77768 - DNA, 15 bp, Artificial Sequence
  dgRNA
  Grpel2
gcctacatccaccac

SEQ ID NO: 77769 - DNA, 15 bp, Artificial Sequence
  dgRNA
  Grpel2
gagtagcgccatgcc

SEQ ID NO: 77770 - DNA, 15 bp, Artificial Sequence
  dgRNA
  Grpel2
agtcccgtgcctgct

SEQ ID NO: 77771 - DNA, 15 bp, Artificial Sequence
  dgRNA
  Dntt
acagtactcaaccag

SEQ ID NO: 77772 - DNA, 15 bp, Artificial Sequence
  dgRNA
  Dntt
actcaaccagtggcg

SEQ ID NO: 77773 - DNA, 15 bp, Artificial Sequence
  dgRNA
  Dntt
gcttactgcgcaagg

SEQ ID NO: 77774 - DNA, 15 bp, Artificial Sequence
  dgRNA
  Dntt
tgcttactgcgcaag

SEQ ID NO: 77775 - DNA, 15 bp, Artificial Sequence
  dgRNA
  Psme3
taggttgaccaccac

SEQ ID NO: 77776 - DNA, 15 bp, Artificial Sequence
  dgRNA
  Psme3
aggttgaccaccaca

SEQ ID NO: 77777 - DNA, 15 bp, Artificial Sequence
  dgRNA
  Psme3
tccgacagcccctcc

SEQ ID NO: 77778 - DNA, 15 bp, Artificial Sequence
  dgRNA
  Psme3
tcagagcggctgcgc

SEQ ID NO: 77779 - DNA, 15 bp, Artificial Sequence
  dgRNA
  Tk1
ttgcgactcacagca

SEQ ID NO: 77780 - DNA, 15 bp, Artificial Sequence
  dgRNA
  Tk1
ccccttagttcctgc

SEQ ID NO: 77781 - DNA, 15 bp, Artificial Sequence
  dgRNA
  Tk1
gtcgcaaagtaaggc

SEQ ID NO: 77782 - DNA, 15 bp, Artificial Sequence
  dgRNA
  Tk1
gtgagtcgcaaagta

SEQ ID NO: 77783 - DNA, 15 bp, Artificial Sequence
  dgRNA
  Gtf3c4
ttcagtcacccacgg

SEQ ID NO: 77784 - DNA, 15 bp, Artificial Sequence
  dgRNA
  Gtf3c4
aggctcactctcccg

SEQ ID NO: 77785 - DNA, 15 bp, Artificial Sequence
  dgRNA
  Gtf3c4
ggctcactctcccgt

SEQ ID NO: 77786 - DNA, 15 bp, Artificial Sequence
  dgRNA
  Gtf3c4
ctgagaagaccagcg

SEQ ID NO: 77787 - DNA, 15 bp, Artificial Sequence
  dgRNA
  Wdr77
attgtctgcgaagag

SEQ ID NO: 77788 - DNA, 15 bp, Artificial Sequence
  dgRNA
  Wdr77
ttgtctgcgaagagc

SEQ ID NO: 77789 - DNA, 15 bp, Artificial Sequence
  dgRNA
  Wdr77
cgaagagcgggacag

SEQ ID NO: 77790 - DNA, 15 bp, Artificial Sequence
  dgRNA
  Wdr77
gaagagcgggacagc

SEQ ID NO: 77791 - DNA, 15 bp, Artificial Sequence
  dgRNA
  Rps13
cgccgccatgccttc

SEQ ID NO: 77792 - DNA, 15 bp, Artificial Sequence
  dgRNA
  Rps13
ggacgcgtagtctcc

SEQ ID NO: 77793 - DNA, 15 bp, Artificial Sequence
  dgRNA
  Rps13
gacgcgtagtctccc

SEQ ID NO: 77794 - DNA, 15 bp, Artificial Sequence
  dgRNA
  Rps13
tagtctcccgggctc

SEQ ID NO: 77795 - DNA, 15 bp, Artificial Sequence
  dgRNA
  Pon1
aagggctcaccctcc

SEQ ID NO: 77796 - DNA, 15 bp, Artificial Sequence
  dgRNA
  Pon1
ggcacattttttccc

SEQ ID NO: 77797 - DNA, 15 bp, Artificial Sequence
  dgRNA
  Pon1
ttctcgccttataat

SEQ ID NO: 77798 - DNA, 15 bp, Artificial Sequence
  dgRNA
  Pon1
tctcgccttataatt

SEQ ID NO: 77799 - DNA, 15 bp, Artificial Sequence
  dgRNA
  Zscan12
acacaaacgcgaaac

SEQ ID NO: 77800 - DNA, 15 bp, Artificial Sequence
  dgRNA
  Zscan12
acgcgaaaccggata

SEQ ID NO: 77801 - DNA, 15 bp, Artificial Sequence
  dgRNA
  Zscan12
aaaccggataaggac

SEQ ID NO: 77802 - DNA, 15 bp, Artificial Sequence
  dgRNA
  Zscan12
ggacaaaccactgag

SEQ ID NO: 77803 - DNA, 15 bp, Artificial Sequence
  dgRNA
  Rnf31
aattaacccctcgca

SEQ ID NO: 77804 - DNA, 15 bp, Artificial Sequence
  dgRNA
  Rnf31
attaacccctcgcat

SEQ ID NO: 77805 - DNA, 15 bp, Artificial Sequence
  dgRNA
  Rnf31
aacccctcgcatggg

SEQ ID NO: 77806 - DNA, 15 bp, Artificial Sequence
  dgRNA
  Rnf31
ccctcgcatgggagg

SEQ ID NO: 77807 - DNA, 15 bp, Artificial Sequence
  dgRNA
  Btg3
cctcggggctcgcgc

SEQ ID NO: 77808 - DNA, 15 bp, Artificial Sequence
  dgRNA
  Btg3
cggggctcgcgcagg

SEQ ID NO: 77809 - DNA, 15 bp, Artificial Sequence
  dgRNA
  Btg3
gacctcgtgccagca

SEQ ID NO: 77810 - DNA, 15 bp, Artificial Sequence
  dgRNA
  Btg3
tgccagcacggccgt

SEQ ID NO: 77811 - DNA, 15 bp, Artificial Sequence
  dgRNA
  4930447C04Rik
tttgaccgctccacc

SEQ ID NO: 77812 - DNA, 15 bp, Artificial Sequence
  dgRNA
  4930447C04Rik
ttgaccgctccacct

SEQ ID NO: 77813 - DNA, 15 bp, Artificial Sequence
  dgRNA
  4930447C04Rik
atctcgcgagaactg

SEQ ID NO: 77814 - DNA, 15 bp, Artificial Sequence
  dgRNA
  4930447C04Rik
ctgtggcctaccacg

SEQ ID NO: 77815 - DNA, 15 bp, Artificial Sequence
  dgRNA
  Traf7
cggaagtcgtagttt

SEQ ID NO: 77816 - DNA, 15 bp, Artificial Sequence
  dgRNA
  Traf7
agttccgacctgccc

SEQ ID NO: 77817 - DNA, 15 bp, Artificial Sequence
  dgRNA
  Traf7
gttccgacctgcccc

SEQ ID NO: 77818 - DNA, 15 bp, Artificial Sequence
  dgRNA
  Traf7
ctgccccgggacttc

SEQ ID NO: 77819 - DNA, 15 bp, Artificial Sequence
  dgRNA
  Eif2ak4
cagagtcacgcccct

SEQ ID NO: 77820 - DNA, 15 bp, Artificial Sequence
  dgRNA
  Eif2ak4
gtcacgcccctaggt

SEQ ID NO: 77821 - DNA, 15 bp, Artificial Sequence
  dgRNA
  Eif2ak4
cgagactccgccccc

SEQ ID NO: 77822 - DNA, 15 bp, Artificial Sequence
  dgRNA
  Eif2ak4
aggttcgtctcccgc

SEQ ID NO: 77823 - DNA, 15 bp, Artificial Sequence
  dgRNA
  Dgkk
tcttgcctggcctac

SEQ ID NO: 77824 - DNA, 15 bp, Artificial Sequence
  dgRNA
  Dgkk
gaaattagttccacc

SEQ ID NO: 77825 - DNA, 15 bp, Artificial Sequence
  dgRNA
  Dgkk
actagcctgtaggcc

SEQ ID NO: 77826 - DNA, 15 bp, Artificial Sequence
  dgRNA
  Dgkk
atactactagcctgt

SEQ ID NO: 77827 - DNA, 15 bp, Artificial Sequence
  dgRNA
  Kctd9
cggtctgggcgcggt

SEQ ID NO: 77828 - DNA, 15 bp, Artificial Sequence
  dgRNA
  Kctd9
ggtctgggcgcggtt

SEQ ID NO: 77829 - DNA, 15 bp, Artificial Sequence
  dgRNA
  Kctd9
gtctgggcgcggttg

SEQ ID NO: 77830 - DNA, 15 bp, Artificial Sequence
  dgRNA
  Kctd9
tctgggcgcggttgg

SEQ ID NO: 77831 - DNA, 15 bp, Artificial Sequence
  dgRNA
  Serpinb5
gcccgtgcttgtcgc

SEQ ID NO: 77832 - DNA, 15 bp, Artificial Sequence
  dgRNA
  Serpinb5
cttccaatcttgcac

SEQ ID NO: 77833 - DNA, 15 bp, Artificial Sequence
  dgRNA
  Serpinb5
caagcacgggcagga

SEQ ID NO: 77834 - DNA, 15 bp, Artificial Sequence
  dgRNA
  Serpinb5
gcgacaagcacgggc

SEQ ID NO: 77835 - DNA, 15 bp, Artificial Sequence
  dgRNA
  Krt7
ctcacgacggcgtct

SEQ ID NO: 77836 - DNA, 15 bp, Artificial Sequence
  dgRNA
  Krt7
cagacacttcccgag

SEQ ID NO: 77837 - DNA, 15 bp, Artificial Sequence
  dgRNA
  Krt7
gtggacgaagagcct

SEQ ID NO: 77838 - DNA, 15 bp, Artificial Sequence
  dgRNA
  Krt7
tggacgaagagcctt

SEQ ID NO: 77839 - DNA, 15 bp, Artificial Sequence
  dgRNA
  Rhcg
ccagttcacccgaac

SEQ ID NO: 77840 - DNA, 15 bp, Artificial Sequence
  dgRNA
  Rhcg
cagttcacccgaaca

SEQ ID NO: 77841 - DNA, 15 bp, Artificial Sequence
  dgRNA
  Rhcg
ttcacccgaacaggg

SEQ ID NO: 77842 - DNA, 15 bp, Artificial Sequence
  dgRNA
  Rhcg
tcacccgaacagggc

SEQ ID NO: 77843 - DNA, 15 bp, Artificial Sequence
  dgRNA
  Slc12a6
tagctttctgccgcc

SEQ ID NO: 77844 - DNA, 15 bp, Artificial Sequence
  dgRNA
  Slc12a6
cagttggagttctac

SEQ ID NO: 77845 - DNA, 15 bp, Artificial Sequence
  dgRNA
  Slc12a6
gataaacagggcgga

SEQ ID NO: 77846 - DNA, 15 bp, Artificial Sequence
  dgRNA
  Slc12a6
agcgtcccactccct

SEQ ID NO: 77847 - DNA, 15 bp, Artificial Sequence
  dgRNA
  Brip1
tcccagtctttttcg

SEQ ID NO: 77848 - DNA, 15 bp, Artificial Sequence
  dgRNA
  Brip1
ccagtctttttcgcg

SEQ ID NO: 77849 - DNA, 15 bp, Artificial Sequence
  dgRNA
  Brip1
gtctttttcgcgggg

SEQ ID NO: 77850 - DNA, 15 bp, Artificial Sequence
  dgRNA
  Brip1
tctttttcgcggggt

SEQ ID NO: 77851 - DNA, 15 bp, Artificial Sequence
  dgRNA
  Tmem14a
ccaaccctgcgctct

SEQ ID NO: 77852 - DNA, 15 bp, Artificial Sequence
  dgRNA
  Tmem14a
aaccctgcgctctcg

SEQ ID NO: 77853 - DNA, 15 bp, Artificial Sequence
  dgRNA
  Tmem14a
cggggcctacacagc

SEQ ID NO: 77854 - DNA, 15 bp, Artificial Sequence
  dgRNA
  Tmem14a
gcgacttcacttccc

SEQ ID NO: 77855 - DNA, 15 bp, Artificial Sequence
  dgRNA
  Stx2
caagcgcagagagcg

SEQ ID NO: 77856 - DNA, 15 bp, Artificial Sequence
  dgRNA
  Stx2
aagcgcagagagcgc

SEQ ID NO: 77857 - DNA, 15 bp, Artificial Sequence
  dgRNA
  Stx2
cgggcgcggttgccg

SEQ ID NO: 77858 - DNA, 15 bp, Artificial Sequence
  dgRNA
  Cdc16
tcttccactcccgga

SEQ ID NO: 77859 - DNA, 15 bp, Artificial Sequence
  dgRNA
  Cdc16
cactcccggaaggca

SEQ ID NO: 77860 - DNA, 15 bp, Artificial Sequence
  dgRNA
  Cdc16
ttccctcccggacaa

SEQ ID NO: 77861 - DNA, 15 bp, Artificial Sequence
  dgRNA
  Cdc16
cggacaaaggcgaac

SEQ ID NO: 77862 - DNA, 15 bp, Artificial Sequence
  dgRNA
  Zdhhc5
cgccgcggtcgcccg

SEQ ID NO: 77863 - DNA, 15 bp, Artificial Sequence
  dgRNA
  Zdhhc5
cgctctagagcgccg

SEQ ID NO: 77864 - DNA, 15 bp, Artificial Sequence
  dgRNA
  Zdhhc5
gctctagagcgccgt

SEQ ID NO: 77865 - DNA, 15 bp, Artificial Sequence
  dgRNA
  Zdhhc5
ctctagagcgccgtg

SEQ ID NO: 77866 - DNA, 15 bp, Artificial Sequence
  dgRNA
  Cep120
cttgcgaccagcagg

SEQ ID NO: 77867 - DNA, 15 bp, Artificial Sequence
  dgRNA
  Cep120
gcagccgcgtctccc

SEQ ID NO: 77868 - DNA, 15 bp, Artificial Sequence
  dgRNA
  Cep120
cagccgcgtctcccc

SEQ ID NO: 77869 - DNA, 15 bp, Artificial Sequence
  dgRNA
  Cep120
agccgcgtctccccg

SEQ ID NO: 77870 - DNA, 15 bp, Artificial Sequence
  dgRNA
  Pfkfb2
cgagctgacagcctt

SEQ ID NO: 77871 - DNA, 15 bp, Artificial Sequence
  dgRNA
  Pfkfb2
gccttaggctgtcac

SEQ ID NO: 77872 - DNA, 15 bp, Artificial Sequence
  dgRNA
  Pfkfb2
gtccagcgtgcctcc

SEQ ID NO: 77873 - DNA, 15 bp, Artificial Sequence
  dgRNA
  Pfkfb2
gcgtgcctccaggtg

SEQ ID NO: 77874 - DNA, 15 bp, Artificial Sequence
  dgRNA
  Rbm43
cgggcgcagcaggtc

SEQ ID NO: 77875 - DNA, 15 bp, Artificial Sequence
  dgRNA
  Rbm43
tctggctcccacgcg

SEQ ID NO: 77876 - DNA, 15 bp, Artificial Sequence
  dgRNA
  Rbm43
ctggctcccacgcgt

SEQ ID NO: 77877 - DNA, 15 bp, Artificial Sequence
  dgRNA
  Rbm43
tggctcccacgcgtg

SEQ ID NO: 77878 - DNA, 15 bp, Artificial Sequence
  dgRNA
  Bnipl
cccctcactccttag

SEQ ID NO: 77879 - DNA, 15 bp, Artificial Sequence
  dgRNA
  Bnipl
ccctcactccttagc

SEQ ID NO: 77880 - DNA, 15 bp, Artificial Sequence
  dgRNA
  Bnipl
tagcgggcaaaacaa

SEQ ID NO: 77881 - DNA, 15 bp, Artificial Sequence
  dgRNA
  Bnipl
agcgggcaaaacaaa

SEQ ID NO: 77882 - DNA, 15 bp, Artificial Sequence
  dgRNA
  Hmox2
cgatcaacaagcagt

SEQ ID NO: 77883 - DNA, 15 bp, Artificial Sequence
  dgRNA
  Hmox2
cgaagctttctcaga

SEQ ID NO: 77884 - DNA, 15 bp, Artificial Sequence
  dgRNA
  Hmox2
tagctgccgtgcgcc

SEQ ID NO: 77885 - DNA, 15 bp, Artificial Sequence
  dgRNA
  Hmox2
agctgccgtgcgcct

SEQ ID NO: 77886 - DNA, 15 bp, Artificial Sequence
  dgRNA
  Rtn2
ttcgttttgaaagcc

SEQ ID NO: 77887 - DNA, 15 bp, Artificial Sequence
  dgRNA
  Rtn2
tcgttttgaaagcct

SEQ ID NO: 77888 - DNA, 15 bp, Artificial Sequence
  dgRNA
  Rtn2
tactaagtcccaaat

SEQ ID NO: 77889 - DNA, 15 bp, Artificial Sequence
  dgRNA
  Rtn2
actaagtcccaaatt

SEQ ID NO: 77890 - DNA, 15 bp, Artificial Sequence
  dgRNA
  Specc1l
agcacagcgcgtgcg

SEQ ID NO: 77891 - DNA, 15 bp, Artificial Sequence
  dgRNA
  Specc1l
gaactcagcgcgaag

SEQ ID NO: 77892 - DNA, 15 bp, Artificial Sequence
  dgRNA
  Specc1l
ctcagcgcgaagagg

SEQ ID NO: 77893 - DNA, 15 bp, Artificial Sequence
  dgRNA
  Specc1l
gcgcagtagcagccc

SEQ ID NO: 77894 - DNA, 15 bp, Artificial Sequence
  dgRNA
  Tmem29
ttgccatggtttcgc

SEQ ID NO: 77895 - DNA, 15 bp, Artificial Sequence
  dgRNA
  Tmem29
ccatggtttcgcggg

SEQ ID NO: 77896 - DNA, 15 bp, Artificial Sequence
  dgRNA
  Tmem29
catggtttcgcgggc

SEQ ID NO: 77897 - DNA, 15 bp, Artificial Sequence
  dgRNA
  Tmem29
ggcgggacttaaaag

SEQ ID NO: 77898 - DNA, 15 bp, Artificial Sequence
  dgRNA
  Zfp788
agccgagccagttct

SEQ ID NO: 77899 - DNA, 15 bp, Artificial Sequence
  dgRNA
  Zfp788
cgagccagttctggg

SEQ ID NO: 77900 - DNA, 15 bp, Artificial Sequence
  dgRNA
  Zfp788
cactggagctcattc

SEQ ID NO: 77901 - DNA, 15 bp, Artificial Sequence
  dgRNA
  Zfp788
ttcaggtccgcacat

SEQ ID NO: 77902 - DNA, 15 bp, Artificial Sequence
  dgRNA
  Olfr503
aagcaattccacagt

SEQ ID NO: 77903 - DNA, 15 bp, Artificial Sequence
  dgRNA
  Gins3
tagtctacaagctgc

SEQ ID NO: 77904 - DNA, 15 bp, Artificial Sequence
  dgRNA
  Gins3
tctacaagctgcagg

SEQ ID NO: 77905 - DNA, 15 bp, Artificial Sequence
  dgRNA
  Gins3
ccggccgactcatcc

SEQ ID NO: 77906 - DNA, 15 bp, Artificial Sequence
  dgRNA
  Gins3
cggccgactcatcca

SEQ ID NO: 77907 - DNA, 15 bp, Artificial Sequence
  dgRNA
  Cdc5l
ggaccaagcgtgctg

SEQ ID NO: 77908 - DNA, 15 bp, Artificial Sequence
  dgRNA
  Cdc5l
cctccgcgtgacgtc

SEQ ID NO: 77909 - DNA, 15 bp, Artificial Sequence
  dgRNA
  Cdc5l
ccttcactgcgttcc

SEQ ID NO: 77910 - DNA, 15 bp, Artificial Sequence
  dgRNA
  Cdc5l
gtcaagttccaactc

SEQ ID NO: 77911 - DNA, 15 bp, Artificial Sequence
  dgRNA
  Farsb
cgggtccttcactct

SEQ ID NO: 77912 - DNA, 15 bp, Artificial Sequence
  dgRNA
  Farsb
gggtccttcactcta

SEQ ID NO: 77913 - DNA, 15 bp, Artificial Sequence
  dgRNA
  Farsb
actctagggtcgctg

SEQ ID NO: 77914 - DNA, 15 bp, Artificial Sequence
  dgRNA
  Farsb
ccccgcatgtggcgc

SEQ ID NO: 77915 - DNA, 15 bp, Artificial Sequence
  dgRNA
  Spag9
cggtccgcgcgcgcg

SEQ ID NO: 77916 - DNA, 15 bp, Artificial Sequence
  dgRNA
  Spag9
cgcgcgcgcggcgcc

SEQ ID NO: 77917 - DNA, 15 bp, Artificial Sequence
  dgRNA
  Spag9
cgcggcgccgggtgt

SEQ ID NO: 77918 - DNA, 15 bp, Artificial Sequence
  dgRNA
  Spag9
tgttggcgtcacagc

SEQ ID NO: 77919 - DNA, 15 bp, Artificial Sequence
  dgRNA
  Desi2
cttcgcaggactttc

SEQ ID NO: 77920 - DNA, 15 bp, Artificial Sequence
  dgRNA
  Desi2
ttcgcaggactttct

SEQ ID NO: 77921 - DNA, 15 bp, Artificial Sequence
  dgRNA
  Desi2
cgaagagtttgtcag

SEQ ID NO: 77922 - DNA, 15 bp, Artificial Sequence
  dgRNA
  Desi2
gcgaagagtttgtca

SEQ ID NO: 77923 - DNA, 15 bp, Artificial Sequence
  dgRNA
  Zfp668
tctagcccagttccg

SEQ ID NO: 77924 - DNA, 15 bp, Artificial Sequence
  dgRNA
  Zfp668
cgcgaaacttccgcc

SEQ ID NO: 77925 - DNA, 15 bp, Artificial Sequence
  dgRNA
  Zfp668
gcgaaacttccgcct

SEQ ID NO: 77926 - DNA, 15 bp, Artificial Sequence
  dgRNA
  Zfp668
ggcagtgtttccgca

SEQ ID NO: 77927 - DNA, 15 bp, Artificial Sequence
  dgRNA
  Fgf2
gtcaccgcagtctcc

SEQ ID NO: 77928 - DNA, 15 bp, Artificial Sequence
  dgRNA
  Fgf2
aaagctctgcctagc

SEQ ID NO: 77929 - DNA, 15 bp, Artificial Sequence
  dgRNA
  Fgf2
gcaacttggaggcgc

SEQ ID NO: 77930 - DNA, 15 bp, Artificial Sequence
  dgRNA
  Fgf2
caacttggaggcgcc

SEQ ID NO: 77931 - DNA, 15 bp, Artificial Sequence
  dgRNA
  Lrriq4
ccttcgcctagagcc

SEQ ID NO: 77932 - DNA, 15 bp, Artificial Sequence
  dgRNA
  Lrriq4
acccagctcgctttg

SEQ ID NO: 77933 - DNA, 15 bp, Artificial Sequence
  dgRNA
  Lrriq4
cctcgacctctaaag

SEQ ID NO: 77934 - DNA, 15 bp, Artificial Sequence
  dgRNA
  Lrriq4
agaggaaggccgccg

SEQ ID NO: 77935 - DNA, 15 bp, Artificial Sequence
  dgRNA
  Prkca
gttggcggggctcac

SEQ ID NO: 77936 - DNA, 15 bp, Artificial Sequence
  dgRNA
  Prkca
ttggcggggctcaca

SEQ ID NO: 77937 - DNA, 15 bp, Artificial Sequence
  dgRNA
  Prkca
tggcggggctcacag

SEQ ID NO: 77938 - DNA, 15 bp, Artificial Sequence
  dgRNA
  Prkca
ggcccaaggctcgcc

SEQ ID NO: 77939 - DNA, 15 bp, Artificial Sequence
  dgRNA
  Zc3h13
cagaccttagtaaac

SEQ ID NO: 77940 - DNA, 15 bp, Artificial Sequence
  dgRNA
  Zc3h13
tagtaaacaggcgtc

SEQ ID NO: 77941 - DNA, 15 bp, Artificial Sequence
  dgRNA
  Zc3h13
gcactgccctcgcgt

SEQ ID NO: 77942 - DNA, 15 bp, Artificial Sequence
  dgRNA
  Zc3h13
ctcgcgtcggacgcg

SEQ ID NO: 77943 - DNA, 15 bp, Artificial Sequence
  dgRNA
  Mcm9
aattcattatctggc

SEQ ID NO: 77944 - DNA, 15 bp, Artificial Sequence
  dgRNA
  Mcm9
gctaaattttataag

SEQ ID NO: 77945 - DNA, 15 bp, Artificial Sequence
  dgRNA
  Rhoc
ccctacgccccttgc

SEQ ID NO: 77946 - DNA, 15 bp, Artificial Sequence
  dgRNA
  Rhoc
cctacgccccttgcc

SEQ ID NO: 77947 - DNA, 15 bp, Artificial Sequence
  dgRNA
  Rhoc
tgccgggtcctcagc

SEQ ID NO: 77948 - DNA, 15 bp, Artificial Sequence
  dgRNA
  Rhoc
ccgggtcctcagccg

SEQ ID NO: 77949 - DNA, 15 bp, Artificial Sequence
  dgRNA
  Fbxw7
cgatccgagcccgcc

SEQ ID NO: 77950 - DNA, 15 bp, Artificial Sequence
  dgRNA
  Fbxw7
tccacaccagccgcc

SEQ ID NO: 77951 - DNA, 15 bp, Artificial Sequence
  dgRNA
  Fbxw7
cacaccagccgcccg

SEQ ID NO: 77952 - DNA, 15 bp, Artificial Sequence
  dgRNA
  Fbxw7
cgtagcatcccatag

SEQ ID NO: 77953 - DNA, 15 bp, Artificial Sequence
  dgRNA
  Calcoco2
aaccagtttgccatc

SEQ ID NO: 77954 - DNA, 15 bp, Artificial Sequence
  dgRNA
  Calcoco2
accagtttgccatcg

SEQ ID NO: 77955 - DNA, 15 bp, Artificial Sequence
  dgRNA
  Calcoco2
tcggggtgataaaaa

SEQ ID NO: 77956 - DNA, 15 bp, Artificial Sequence
  dgRNA
  Calcoco2
agctgtcccgcggca

SEQ ID NO: 77957 - DNA, 15 bp, Artificial Sequence
  dgRNA
  D1Pas1
cagcttggaaacgac

SEQ ID NO: 77958 - DNA, 15 bp, Artificial Sequence
  dgRNA
  D1Pas1
gaaaaggtggagcgc

SEQ ID NO: 77959 - DNA, 15 bp, Artificial Sequence
  dgRNA
  D1Pas1
cgccatagtgagcag

SEQ ID NO: 77960 - DNA, 15 bp, Artificial Sequence
  dgRNA
  D1Pas1
cagcggagagccaag

SEQ ID NO: 77961 - DNA, 15 bp, Artificial Sequence
  dgRNA
  Slc44a4
ggtccgtagcagacc

SEQ ID NO: 77962 - DNA, 15 bp, Artificial Sequence
  dgRNA
  Slc44a4
cggtaagcagctcct

SEQ ID NO: 77963 - DNA, 15 bp, Artificial Sequence
  dgRNA
  Slc44a4
agccctggtacccct

SEQ ID NO: 77964 - DNA, 15 bp, Artificial Sequence
  dgRNA
  Slc44a4
cggggctgtgacgtc

SEQ ID NO: 77965 - DNA, 15 bp, Artificial Sequence
  dgRNA
  Ccl20
cacaggagcactcgc

SEQ ID NO: 77966 - DNA, 15 bp, Artificial Sequence
  dgRNA
  Ccl20
acaggagcactcgca

SEQ ID NO: 77967 - DNA, 15 bp, Artificial Sequence
  dgRNA
  Ccl20
cactcgcagggcact

SEQ ID NO: 77968 - DNA, 15 bp, Artificial Sequence
  dgRNA
  Ctsj
caaccttctatcgtc

SEQ ID NO: 77969 - DNA, 15 bp, Artificial Sequence
  dgRNA
  Ctsj
gagcttgacgctgga

SEQ ID NO: 77970 - DNA, 15 bp, Artificial Sequence
  dgRNA
  Ctsj
ggttgagcttgacgc

SEQ ID NO: 77971 - DNA, 15 bp, Artificial Sequence
  dgRNA
  Ctsj
catcctgacgataga

SEQ ID NO: 77972 - DNA, 15 bp, Artificial Sequence
  dgRNA
  Olfr686
ataatctgcactcat

SEQ ID NO: 77973 - DNA, 15 bp, Artificial Sequence
  dgRNA
  Tnr
gtctttgactccatc

SEQ ID NO: 77974 - DNA, 15 bp, Artificial Sequence
  dgRNA
  Tnr
gcttttctgtccact

SEQ ID NO: 77975 - DNA, 15 bp, Artificial Sequence
  dgRNA
  Tnr
ggggctacttgtaga

SEQ ID NO: 77976 - DNA, 15 bp, Artificial Sequence
  dgRNA
  Tnr
ctacttgtagaaggc

SEQ ID NO: 77977 - DNA, 15 bp, Artificial Sequence
  dgRNA
  Igll1
gggatgggttaagac

SEQ ID NO: 77978 - DNA, 15 bp, Artificial Sequence
  dgRNA
  Igll1
accgggtagtccctt

SEQ ID NO: 77979 - DNA, 15 bp, Artificial Sequence
  dgRNA
  Igll1
ccgggtagtcccttt

SEQ ID NO: 77980 - DNA, 15 bp, Artificial Sequence
  dgRNA
  Igll1
tacccggttgtggtt

SEQ ID NO: 77981 - DNA, 15 bp, Artificial Sequence
  dgRNA
  Prss23
ggtggtgacgcgctg

SEQ ID NO: 77982 - DNA, 15 bp, Artificial Sequence
  dgRNA
  Prss23
ggagacccacctgcg

SEQ ID NO: 77983 - DNA, 15 bp, Artificial Sequence
  dgRNA
  Prss23
gagacccacctgcgc

SEQ ID NO: 77984 - DNA, 15 bp, Artificial Sequence
  dgRNA
  Prss23
agacccacctgcgcg

SEQ ID NO: 77985 - DNA, 15 bp, Artificial Sequence
  dgRNA
  Lgals12
tcttgtgaccctagc

SEQ ID NO: 77986 - DNA, 15 bp, Artificial Sequence
  dgRNA
  Lgals12
gggactgaacaactt

SEQ ID NO: 77987 - DNA, 15 bp, Artificial Sequence
  dgRNA
  Lgals12
gactgaacaacttgg

SEQ ID NO: 77988 - DNA, 15 bp, Artificial Sequence
  dgRNA
  Lgals12
gggaatgaatgcggg

SEQ ID NO: 77989 - DNA, 15 bp, Artificial Sequence
  dgRNA
  Fam26d
taaatttattagctc

SEQ ID NO: 77990 - DNA, 15 bp, Artificial Sequence
  dgRNA
  Fam26d
cacaagatcatagct

SEQ ID NO: 77991 - DNA, 15 bp, Artificial Sequence
  dgRNA
  Fam26d
acacaagatcatagc

SEQ ID NO: 77992 - DNA, 15 bp, Artificial Sequence
  dgRNA
  Clcn7
actaggcgtgcatct

SEQ ID NO: 77993 - DNA, 15 bp, Artificial Sequence
  dgRNA
  Clcn7
ctaggcgtgcatctc

SEQ ID NO: 77994 - DNA, 15 bp, Artificial Sequence
  dgRNA
  Clcn7
gggctggttcttctc

SEQ ID NO: 77995 - DNA, 15 bp, Artificial Sequence
  dgRNA
  Clcn7
agacactaattgcta

SEQ ID NO: 77996 - DNA, 15 bp, Artificial Sequence
  dgRNA
  Telo2
actaatcaactctct

SEQ ID NO: 77997 - DNA, 15 bp, Artificial Sequence
  dgRNA
  Kdm2a
ccggcggtgtgtccg

SEQ ID NO: 77998 - DNA, 15 bp, Artificial Sequence
  dgRNA
  Kdm2a
tgtgtccgtggtaga

SEQ ID NO: 77999 - DNA, 15 bp, Artificial Sequence
  dgRNA
  Kdm2a
gtgtccgtggtagag

SEQ ID NO: 78000 - DNA, 15 bp, Artificial Sequence
  dgRNA
  Kdm2a
tgtccgtggtagagg

SEQ ID NO: 78001 - DNA, 15 bp, Artificial Sequence
  dgRNA
  Nfya
tgcgtaggcctttgg

SEQ ID NO: 78002 - DNA, 15 bp, Artificial Sequence
  dgRNA
  Nfya
gcgtaggcctttggc

SEQ ID NO: 78003 - DNA, 15 bp, Artificial Sequence
  dgRNA
  Nfya
taggcctttggcggg

SEQ ID NO: 78004 - DNA, 15 bp, Artificial Sequence
  dgRNA
  Nfya
ggcggtgtcaaatcc

SEQ ID NO: 78005 - DNA, 15 bp, Artificial Sequence
  dgRNA
  Rtn4
ttcaggtatatttag

SEQ ID NO: 78006 - DNA, 15 bp, Artificial Sequence
  dgRNA
  Rtn4
ggtatatttagcggt

SEQ ID NO: 78007 - DNA, 15 bp, Artificial Sequence
  dgRNA
  Rtn4
tggactaatccaaat

SEQ ID NO: 78008 - DNA, 15 bp, Artificial Sequence
  dgRNA
  Rtn4
atggactaatccaaa

SEQ ID NO: 78009 - DNA, 15 bp, Artificial Sequence
  dgRNA
  Phf11c
aaagtgggcctaaga

SEQ ID NO: 78010 - DNA, 15 bp, Artificial Sequence
  dgRNA
  Phf11c
caccagttgctctag

SEQ ID NO: 78011 - DNA, 15 bp, Artificial Sequence
  dgRNA
  Phf11c
tctagtggagaattc

SEQ ID NO: 78012 - DNA, 15 bp, Artificial Sequence
  dgRNA
  Phf11c
tcctatagcttattc

SEQ ID NO: 78013 - DNA, 15 bp, Artificial Sequence
  dgRNA
  Rhbdl3
ttgtcgctcgcctcc

SEQ ID NO: 78014 - DNA, 15 bp, Artificial Sequence
  dgRNA
  Rhbdl3
ctccctccccgcggg

SEQ ID NO: 78015 - DNA, 15 bp, Artificial Sequence
  dgRNA
  Rhbdl3
tccccgcgggcggcc

SEQ ID NO: 78016 - DNA, 15 bp, Artificial Sequence
  dgRNA
  Rhbdl3
ccccgcgggcggcct

SEQ ID NO: 78017 - DNA, 15 bp, Artificial Sequence
  dgRNA
  Eif2ak1
cttgtcctgcccact

SEQ ID NO: 78018 - DNA, 15 bp, Artificial Sequence
  dgRNA
  Eif2ak1
tgtcctgcccactcg

SEQ ID NO: 78019 - DNA, 15 bp, Artificial Sequence
  dgRNA
  Eif2ak1
ggggcacacccgcag

SEQ ID NO: 78020 - DNA, 15 bp, Artificial Sequence
  dgRNA
  Eif2ak1
cctgtgggttgtgtc

SEQ ID NO: 78021 - DNA, 15 bp, Artificial Sequence
  dgRNA
  Fam19a3
ttgaactactagact

SEQ ID NO: 78022 - DNA, 15 bp, Artificial Sequence
  dgRNA
  Fam19a3
tgaactactagacta

SEQ ID NO: 78023 - DNA, 15 bp, Artificial Sequence
  dgRNA
  Fam19a3
gaactactagactag

SEQ ID NO: 78024 - DNA, 15 bp, Artificial Sequence
  dgRNA
  Fam19a3
gctgtgcgccacaag

SEQ ID NO: 78025 - DNA, 15 bp, Artificial Sequence
  dgRNA
  Lst1
tgggcttaatagctt

SEQ ID NO: 78026 - DNA, 15 bp, Artificial Sequence
  dgRNA
  Lst1
ctgggcttaatagct

SEQ ID NO: 78027 - DNA, 15 bp, Artificial Sequence
  dgRNA
  Apopt1
gaaaggttggcgtta

SEQ ID NO: 78028 - DNA, 15 bp, Artificial Sequence
  dgRNA
  Apopt1
cgacagtggaaaggt

SEQ ID NO: 78029 - DNA, 15 bp, Artificial Sequence
  dgRNA
  Apopt1
atcgcgacagtggaa

SEQ ID NO: 78030 - DNA, 15 bp, Artificial Sequence
  dgRNA
  Apopt1
gcaggatcgcgacag

SEQ ID NO: 78031 - DNA, 15 bp, Artificial Sequence
  dgRNA
  Tmem164
gcggagccgagcagc

SEQ ID NO: 78032 - DNA, 15 bp, Artificial Sequence
  dgRNA
  Tmem164
cgagcagcgggtgag

SEQ ID NO: 78033 - DNA, 15 bp, Artificial Sequence
  dgRNA
  Tmem164
tcggcggccagtcct

SEQ ID NO: 78034 - DNA, 15 bp, Artificial Sequence
  dgRNA
  Tmem164
cggcggccagtcctc

SEQ ID NO: 78035 - DNA, 15 bp, Artificial Sequence
  dgRNA
  Ccdc102a
gctcctcgtgggtca

SEQ ID NO: 78036 - DNA, 15 bp, Artificial Sequence
  dgRNA
  Ccdc102a
ggatcacctagaccg

SEQ ID NO: 78037 - DNA, 15 bp, Artificial Sequence
  dgRNA
  Ccdc102a
cacctagaccgtggt

SEQ ID NO: 78038 - DNA, 15 bp, Artificial Sequence
  dgRNA
  Ccdc102a
ctagaccgtggttgg

SEQ ID NO: 78039 - DNA, 15 bp, Artificial Sequence
  dgRNA
  Oog3
aggcctactttggct

SEQ ID NO: 78040 - DNA, 15 bp, Artificial Sequence
  dgRNA
  Oog3
ggcctactttggctt

SEQ ID NO: 78041 - DNA, 15 bp, Artificial Sequence
  dgRNA
  Oog3
gcctactttggcttg

SEQ ID NO: 78042 - DNA, 15 bp, Artificial Sequence
  dgRNA
  Oog3
atggtttagataatt

SEQ ID NO: 78043 - DNA, 15 bp, Artificial Sequence
  dgRNA
  Creb1
tggccgctgcgcact

SEQ ID NO: 78044 - DNA, 15 bp, Artificial Sequence
  dgRNA
  Creb1
ctgcgcactcggcac

SEQ ID NO: 78045 - DNA, 15 bp, Artificial Sequence
  dgRNA
  Creb1
tgcgcactcggcact

SEQ ID NO: 78046 - DNA, 15 bp, Artificial Sequence
  dgRNA
  Creb1
gtgccgagtgcgcag

SEQ ID NO: 78047 - DNA, 15 bp, Artificial Sequence
  dgRNA
  Usp2
tcgctttgccccagt

SEQ ID NO: 78048 - DNA, 15 bp, Artificial Sequence
  dgRNA
  Usp2
cgctttgccccagta

SEQ ID NO: 78049 - DNA, 15 bp, Artificial Sequence
  dgRNA
  Usp2
gttcccgcgtctctg

SEQ ID NO: 78050 - DNA, 15 bp, Artificial Sequence
  dgRNA
  Usp2
cagggtcatcggctt

SEQ ID NO: 78051 - DNA, 15 bp, Artificial Sequence
  dgRNA
  Gm4894
tgccacccactggtt

SEQ ID NO: 78052 - DNA, 15 bp, Artificial Sequence
  dgRNA
  Gm4894
cggatccaatttgtc

SEQ ID NO: 78053 - DNA, 15 bp, Artificial Sequence
  dgRNA
  Gm4894
ggatccaatttgtct

SEQ ID NO: 78054 - DNA, 15 bp, Artificial Sequence
  dgRNA
  Gm4894
ggaaggtataggctt

SEQ ID NO: 78055 - DNA, 15 bp, Artificial Sequence
  dgRNA
  4921530L21Rik
agtcacttgtaagcc

SEQ ID NO: 78056 - DNA, 15 bp, Artificial Sequence
  dgRNA
  Zfp940
cagcaaatccttcat

SEQ ID NO: 78057 - DNA, 15 bp, Artificial Sequence
  dgRNA
  Zfp940
caacccagtctaggt

SEQ ID NO: 78058 - DNA, 15 bp, Artificial Sequence
  dgRNA
  Zfp940
ctaccgcgtcccctc

SEQ ID NO: 78059 - DNA, 15 bp, Artificial Sequence
  dgRNA
  Zfp940
gacgtaagagtcgca

SEQ ID NO: 78060 - DNA, 15 bp, Artificial Sequence
  dgRNA
  Cfc1
ctaatggtttacttc

SEQ ID NO: 78061 - DNA, 15 bp, Artificial Sequence
  dgRNA
  Abcc5
gactacgattccctt

SEQ ID NO: 78062 - DNA, 15 bp, Artificial Sequence
  dgRNA
  Abcc5
tcgtagtccctcatc

SEQ ID NO: 78063 - DNA, 15 bp, Artificial Sequence
  dgRNA
  Abcc5
ttgcgcaagaccgaa

SEQ ID NO: 78064 - DNA, 15 bp, Artificial Sequence
  dgRNA
  Abcc5
cttgcgcaagaccga

SEQ ID NO: 78065 - DNA, 15 bp, Artificial Sequence
  dgRNA
  Zfp346
ttcactggactccta

SEQ ID NO: 78066 - DNA, 15 bp, Artificial Sequence
  dgRNA
  Zfp346
ctcctaaggcgccag

SEQ ID NO: 78067 - DNA, 15 bp, Artificial Sequence
  dgRNA
  Zfp346
gggccccgccccagc

SEQ ID NO: 78068 - DNA, 15 bp, Artificial Sequence
  dgRNA
  Zfp346
cttcgcgagagttgc

SEQ ID NO: 78069 - DNA, 15 bp, Artificial Sequence
  dgRNA
  Agbl4
cccagccggccgctc

SEQ ID NO: 78070 - DNA, 15 bp, Artificial Sequence
  dgRNA
  Agbl4
ccagccggccgctca

SEQ ID NO: 78071 - DNA, 15 bp, Artificial Sequence
  dgRNA
  Agbl4
cagccggccgctcag

SEQ ID NO: 78072 - DNA, 15 bp, Artificial Sequence
  dgRNA
  Agbl4
ccgctcaggggccgc

SEQ ID NO: 78073 - DNA, 15 bp, Artificial Sequence
  dgRNA
  Cib3
ttagtcacgagcagc

SEQ ID NO: 78074 - DNA, 15 bp, Artificial Sequence
  dgRNA
  Cib3
gtcacgagcagctgg

SEQ ID NO: 78075 - DNA, 15 bp, Artificial Sequence
  dgRNA
  Cib3
ggcacagccctgttt

SEQ ID NO: 78076 - DNA, 15 bp, Artificial Sequence
  dgRNA
  Cib3
ctgatgtcccaaaca

SEQ ID NO: 78077 - DNA, 15 bp, Artificial Sequence
  dgRNA
  Dkk4
aagaggggccacgtc

SEQ ID NO: 78078 - DNA, 15 bp, Artificial Sequence
  dgRNA
  Dkk4
ttcggaagagtatgc

SEQ ID NO: 78079 - DNA, 15 bp, Artificial Sequence
  dgRNA
  Dkk4
tatgctggtcagacc

SEQ ID NO: 78080 - DNA, 15 bp, Artificial Sequence
  dgRNA
  Dkk4
ctttttaccccacac

SEQ ID NO: 78081 - DNA, 15 bp, Artificial Sequence
  dgRNA
  Nudt4
tggagcactcgcccg

SEQ ID NO: 78082 - DNA, 15 bp, Artificial Sequence
  dgRNA
  Nudt4
ggagcactcgcccgc

SEQ ID NO: 78083 - DNA, 15 bp, Artificial Sequence
  dgRNA
  Nudt4
cactcgcccgcgggc

SEQ ID NO: 78084 - DNA, 15 bp, Artificial Sequence
  dgRNA
  Nudt4
actcgcccgcgggca

SEQ ID NO: 78085 - DNA, 15 bp, Artificial Sequence
  dgRNA
  Gpr183
cacgtagcatatgtg

SEQ ID NO: 78086 - DNA, 15 bp, Artificial Sequence
  dgRNA
  Gpr183
gaggttaactgatca

SEQ ID NO: 78087 - DNA, 15 bp, Artificial Sequence
  dgRNA
  Olfr297
agcatactaaaacat

SEQ ID NO: 78088 - DNA, 15 bp, Artificial Sequence
  dgRNA
  Olfr297
gttaatacatatatg

SEQ ID NO: 78089 - DNA, 15 bp, Artificial Sequence
  dgRNA
  Olfr297
aagtacaggtttatc

SEQ ID NO: 78090 - DNA, 15 bp, Artificial Sequence
  dgRNA
  Vmn2r79
aagcacctatcttga

SEQ ID NO: 78091 - DNA, 15 bp, Artificial Sequence
  dgRNA
  Vmn2r79
catgaagtatcaggc

SEQ ID NO: 78092 - DNA, 15 bp, Artificial Sequence
  dgRNA
  Vmn2r79
gcatgaagtatcagg

SEQ ID NO: 78093 - DNA, 15 bp, Artificial Sequence
  dgRNA
  Vmn2r79
gcagcatgaagtatc

SEQ ID NO: 78094 - DNA, 15 bp, Artificial Sequence
  dgRNA
  Tcf15
caaacccagagcgta

SEQ ID NO: 78095 - DNA, 15 bp, Artificial Sequence
  dgRNA
  Tcf15
ccagagcgtacggtg

SEQ ID NO: 78096 - DNA, 15 bp, Artificial Sequence
  dgRNA
  Tcf15
cagagcgtacggtga

SEQ ID NO: 78097 - DNA, 15 bp, Artificial Sequence
  dgRNA
  Tcf15
gggtcagaagctccg

SEQ ID NO: 78098 - DNA, 15 bp, Artificial Sequence
  dgRNA
  Cacnb1
cccccttgtcagcca

SEQ ID NO: 78099 - DNA, 15 bp, Artificial Sequence
  dgRNA
  Cacnb1
ccccttgtcagccaa

SEQ ID NO: 78100 - DNA, 15 bp, Artificial Sequence
  dgRNA
  Cacnb1
agtcctacccccagt

SEQ ID NO: 78101 - DNA, 15 bp, Artificial Sequence
  dgRNA
  Cacnb1
cctacccccagtagg

SEQ ID NO: 78102 - DNA, 15 bp, Artificial Sequence
  dgRNA
  Mapre1
accagaatgtgcaac

SEQ ID NO: 78103 - DNA, 15 bp, Artificial Sequence
  dgRNA
  Mapre1
ggactcacacgtcat

SEQ ID NO: 78104 - DNA, 15 bp, Artificial Sequence
  dgRNA
  Mapre1
gaccacgtgcccaac

SEQ ID NO: 78105 - DNA, 15 bp, Artificial Sequence
  dgRNA
  Mapre1
tgtcgatcaagcatt

SEQ ID NO: 78106 - DNA, 15 bp, Artificial Sequence
  dgRNA
  Thsd7b
tggtttggcgagtcc

SEQ ID NO: 78107 - DNA, 15 bp, Artificial Sequence
  dgRNA
  Thsd7b
ggtttggcgagtcct

SEQ ID NO: 78108 - DNA, 15 bp, Artificial Sequence
  dgRNA
  Thsd7b
gggaggctaggcgca

SEQ ID NO: 78109 - DNA, 15 bp, Artificial Sequence
  dgRNA
  Thsd7b
aggctaggcgcaagg

SEQ ID NO: 78110 - DNA, 15 bp, Artificial Sequence
  dgRNA
  Lyrm7
ctcctgtccgtaatt

SEQ ID NO: 78111 - DNA, 15 bp, Artificial Sequence
  dgRNA
  Lyrm7
cgtaatttggcaccg

SEQ ID NO: 78112 - DNA, 15 bp, Artificial Sequence
  dgRNA
  Lyrm7
gaacttcctcctgcg

SEQ ID NO: 78113 - DNA, 15 bp, Artificial Sequence
  dgRNA
  Lyrm7
gaaggcgggctagga

SEQ ID NO: 78114 - DNA, 15 bp, Artificial Sequence
  dgRNA
  Gem
ctcactcccctcaag

SEQ ID NO: 78115 - DNA, 15 bp, Artificial Sequence
  dgRNA
  Gem
tcccctcaaggggat

SEQ ID NO: 78116 - DNA, 15 bp, Artificial Sequence
  dgRNA
  Gem
cccctcaaggggata

SEQ ID NO: 78117 - DNA, 15 bp, Artificial Sequence
  dgRNA
  Gem
ccctcaaggggatag

SEQ ID NO: 78118 - DNA, 15 bp, Artificial Sequence
  dgRNA
  Itm2c
ccctgaaggttttgc

SEQ ID NO: 78119 - DNA, 15 bp, Artificial Sequence
  dgRNA
  Itm2c
cagcctaacacatgt

SEQ ID NO: 78120 - DNA, 15 bp, Artificial Sequence
  dgRNA
  Itm2c
cctaacacatgttgg

SEQ ID NO: 78121 - DNA, 15 bp, Artificial Sequence
  dgRNA
  Itm2c
gaggtgggtaacttg

SEQ ID NO: 78122 - DNA, 15 bp, Artificial Sequence
  dgRNA
  Slc9a3r1
tcttctcccgctgcg

SEQ ID NO: 78123 - DNA, 15 bp, Artificial Sequence
  dgRNA
  Slc9a3r1
tgccgcgccgagtgc

SEQ ID NO: 78124 - DNA, 15 bp, Artificial Sequence
  dgRNA
  Slc9a3r1
tagatttgttcaccc

SEQ ID NO: 78125 - DNA, 15 bp, Artificial Sequence
  dgRNA
  Slc9a3r1
cctggcgcaagagcc

SEQ ID NO: 78126 - DNA, 15 bp, Artificial Sequence
  dgRNA
  Dkkl1
atgagtaaggtcacc

SEQ ID NO: 78127 - DNA, 15 bp, Artificial Sequence
  dgRNA
  Dkkl1
caccaggtgtagacg

SEQ ID NO: 78128 - DNA, 15 bp, Artificial Sequence
  dgRNA
  Dkkl1
catccacgaggagta

SEQ ID NO: 78129 - DNA, 15 bp, Artificial Sequence
  dgRNA
  Dkkl1
ggagtatggcttaag

SEQ ID NO: 78130 - DNA, 15 bp, Artificial Sequence
  dgRNA
  Hspa1b
gttcgctagagagta

SEQ ID NO: 78131 - DNA, 15 bp, Artificial Sequence
  dgRNA
  4930557A04Rik
gctcttgtagactga

SEQ ID NO: 78132 - DNA, 15 bp, Artificial Sequence
  dgRNA
  4930557A04Rik
cttgtagactgaagg

SEQ ID NO: 78133 - DNA, 15 bp, Artificial Sequence
  dgRNA
  4930557A04Rik
tcattagtgcccact

SEQ ID NO: 78134 - DNA, 15 bp, Artificial Sequence
  dgRNA
  4930557A04Rik
gtcattagtgcccac

SEQ ID NO: 78135 - DNA, 15 bp, Artificial Sequence
  dgRNA
  Adamtsl2
gttaaagtgtgcgcc

SEQ ID NO: 78136 - DNA, 15 bp, Artificial Sequence
  dgRNA
  Adamtsl2
cgggggagcagcggt

SEQ ID NO: 78137 - DNA, 15 bp, Artificial Sequence
  dgRNA
  Adamtsl2
cgcccagcctgctgg

SEQ ID NO: 78138 - DNA, 15 bp, Artificial Sequence
  dgRNA
  Adamtsl2
gtcaggcagacgggg

SEQ ID NO: 78139 - DNA, 15 bp, Artificial Sequence
  dgRNA
  Alkbh7
ttgctcagggccgag

SEQ ID NO: 78140 - DNA, 15 bp, Artificial Sequence
  dgRNA
  Alkbh7
gagccagtagctgat

SEQ ID NO: 78141 - DNA, 15 bp, Artificial Sequence
  dgRNA
  Alkbh7
agtagctgatgggcg

SEQ ID NO: 78142 - DNA, 15 bp, Artificial Sequence
  dgRNA
  Alkbh7
tcagccaatagcttg

SEQ ID NO: 78143 - DNA, 15 bp, Artificial Sequence
  dgRNA
  Cnot6
ggcgttcgctggctg

SEQ ID NO: 78144 - DNA, 15 bp, Artificial Sequence
  dgRNA
  Cnot6
gttcgctggctgggg

SEQ ID NO: 78145 - DNA, 15 bp, Artificial Sequence
  dgRNA
  Zc3h11a
cgccatctttgacgc

SEQ ID NO: 78146 - DNA, 15 bp, Artificial Sequence
  dgRNA
  Zc3h11a
tgacgctggcagtcc

SEQ ID NO: 78147 - DNA, 15 bp, Artificial Sequence
  dgRNA
  Zc3h11a
gacgctggcagtcct

SEQ ID NO: 78148 - DNA, 15 bp, Artificial Sequence
  dgRNA
  Zc3h11a
ctgctgtgaggacgg

SEQ ID NO: 78149 - DNA, 15 bp, Artificial Sequence
  dgRNA
  Tas2r118
tgtccgtttcatatt

SEQ ID NO: 78150 - DNA, 15 bp, Artificial Sequence
  dgRNA
  Tas2r118
ttcatattcggaaag

SEQ ID NO: 78151 - DNA, 15 bp, Artificial Sequence
  dgRNA
  Tas2r118
ggtcaaattcacaca

SEQ ID NO: 78152 - DNA, 15 bp, Artificial Sequence
  dgRNA
  Tas2r118
gagggcacttctttg

SEQ ID NO: 78153 - DNA, 15 bp, Artificial Sequence
  dgRNA
  Olfr1419
accaacactctgagg

SEQ ID NO: 78154 - DNA, 15 bp, Artificial Sequence
  dgRNA
  Fam81a
cgacgcgccctacga

SEQ ID NO: 78155 - DNA, 15 bp, Artificial Sequence
  dgRNA
  Fam81a
gacgcgccctacgac

SEQ ID NO: 78156 - DNA, 15 bp, Artificial Sequence
  dgRNA
  Fam81a
cctacgacgggactg

SEQ ID NO: 78157 - DNA, 15 bp, Artificial Sequence
  dgRNA
  Fam81a
ctccctgcagcgaac

SEQ ID NO: 78158 - DNA, 15 bp, Artificial Sequence
  dgRNA
  Klhl6
ggtgtttgtagtaac

SEQ ID NO: 78159 - DNA, 15 bp, Artificial Sequence
  dgRNA
  Klhl6
acagctggtgataag

SEQ ID NO: 78160 - DNA, 15 bp, Artificial Sequence
  dgRNA
  Klhl6
gctggtgataagtgg

SEQ ID NO: 78161 - DNA, 15 bp, Artificial Sequence
  dgRNA
  Klhl6
ctggtgataagtgga

SEQ ID NO: 78162 - DNA, 15 bp, Artificial Sequence
  dgRNA
  Irx1
gccgtgcgcgcccac

SEQ ID NO: 78163 - DNA, 15 bp, Artificial Sequence
  dgRNA
  Irx1
gtgcgcgcccaccgg

SEQ ID NO: 78164 - DNA, 15 bp, Artificial Sequence
  dgRNA
  Irx1
cgcgcccaccggagg

SEQ ID NO: 78165 - DNA, 15 bp, Artificial Sequence
  dgRNA
  Irx1
gcccaccggaggagg

SEQ ID NO: 78166 - DNA, 15 bp, Artificial Sequence
  dgRNA
  Fam210a
ggagtcccggcgttc

SEQ ID NO: 78167 - DNA, 15 bp, Artificial Sequence
  dgRNA
  Fam210a
ccacgattctgtttg

SEQ ID NO: 78168 - DNA, 15 bp, Artificial Sequence
  dgRNA
  Fam210a
ttgttacgtcacttc

SEQ ID NO: 78169 - DNA, 15 bp, Artificial Sequence
  dgRNA
  Fam210a
tgttacgtcacttcc

SEQ ID NO: 78170 - DNA, 15 bp, Artificial Sequence
  dgRNA
  Hoxd13
gatgagctaacctgt

SEQ ID NO: 78171 - DNA, 15 bp, Artificial Sequence
  dgRNA
  Hoxd13
gagctaacctgttgg

SEQ ID NO: 78172 - DNA, 15 bp, Artificial Sequence
  dgRNA
  Hoxd13
agctaacctgttgga

SEQ ID NO: 78173 - DNA, 15 bp, Artificial Sequence
  dgRNA
  Hoxd13
taacctgttggaggg

SEQ ID NO: 78174 - DNA, 15 bp, Artificial Sequence
  dgRNA
  Prss22
ctagaacccagtaac

SEQ ID NO: 78175 - DNA, 15 bp, Artificial Sequence
  dgRNA
  Prss22
cctggggcaacctgt

SEQ ID NO: 78176 - DNA, 15 bp, Artificial Sequence
  dgRNA
  Prss22
ctggggcaacctgta

SEQ ID NO: 78177 - DNA, 15 bp, Artificial Sequence
  dgRNA
  Prss22
tcagttgtatgcccg

SEQ ID NO: 78178 - DNA, 15 bp, Artificial Sequence
  dgRNA
  Dnmt3l
ttcggggaaagggtg

SEQ ID NO: 78179 - DNA, 15 bp, Artificial Sequence
  dgRNA
  Dnmt3l
cttcggggaaagggt

SEQ ID NO: 78180 - DNA, 15 bp, Artificial Sequence
  dgRNA
  Gm5615
gtctctatactaagt

SEQ ID NO: 78181 - DNA, 15 bp, Artificial Sequence
  dgRNA
  Gm5615
tgtctctatactaag

SEQ ID NO: 78182 - DNA, 15 bp, Artificial Sequence
  dgRNA
  Sh3rf3
gcggcgcggcagcac

SEQ ID NO: 78183 - DNA, 15 bp, Artificial Sequence
  dgRNA
  Sh3rf3
aggtgttgcccgcag

SEQ ID NO: 78184 - DNA, 15 bp, Artificial Sequence
  dgRNA
  Sh3rf3
tgttgcccgcagcgg

SEQ ID NO: 78185 - DNA, 15 bp, Artificial Sequence
  dgRNA
  Sh3rf3
gcggtgcgcgcgcgt

SEQ ID NO: 78186 - DNA, 15 bp, Artificial Sequence
  dgRNA
  Ly6h
agcgggagacctaga

SEQ ID NO: 78187 - DNA, 15 bp, Artificial Sequence
  dgRNA
  Ly6h
aaggggcgttgcgcg

SEQ ID NO: 78188 - DNA, 15 bp, Artificial Sequence
  dgRNA
  Ly6h
ttgcgcgcggacgaa

SEQ ID NO: 78189 - DNA, 15 bp, Artificial Sequence
  dgRNA
  Ly6h
ggacgaaaggcgccg

SEQ ID NO: 78190 - DNA, 15 bp, Artificial Sequence
  dgRNA
  Resp18
gaatggcggcttatc

SEQ ID NO: 78191 - DNA, 15 bp, Artificial Sequence
  dgRNA
  Resp18
ttggccgaattgcag

SEQ ID NO: 78192 - DNA, 15 bp, Artificial Sequence
  dgRNA
  Resp18
gccgaattgcagagg

SEQ ID NO: 78193 - DNA, 15 bp, Artificial Sequence
  dgRNA
  Resp18
ccgaattgcagagga

SEQ ID NO: 78194 - DNA, 15 bp, Artificial Sequence
  dgRNA
  Adra1d
gagccaccgctcgcc

SEQ ID NO: 78195 - DNA, 15 bp, Artificial Sequence
  dgRNA
  Adra1d
tcgccaggacacgct

SEQ ID NO: 78196 - DNA, 15 bp, Artificial Sequence
  dgRNA
  Adra1d
aggacacgcttggag

SEQ ID NO: 78197 - DNA, 15 bp, Artificial Sequence
  dgRNA
  Adra1d
ggacacgcttggaga

SEQ ID NO: 78198 - DNA, 15 bp, Artificial Sequence
  dgRNA
  Ell3
caagaagaaaccgct

SEQ ID NO: 78199 - DNA, 15 bp, Artificial Sequence
  dgRNA
  Ell3
aagaagaaaccgctt

SEQ ID NO: 78200 - DNA, 15 bp, Artificial Sequence
  dgRNA
  Ell3
aaaccgcttgggttc

SEQ ID NO: 78201 - DNA, 15 bp, Artificial Sequence
  dgRNA
  Ell3
gaggtaccgcccaca

SEQ ID NO: 78202 - DNA, 15 bp, Artificial Sequence
  dgRNA
  2610528A11Rik
ggtttattatcctgt

SEQ ID NO: 78203 - DNA, 15 bp, Artificial Sequence
  dgRNA
  2610528A11Rik
tattatcctgttggg

SEQ ID NO: 78204 - DNA, 15 bp, Artificial Sequence
  dgRNA
  2610528A11Rik
attatcctgttggga

SEQ ID NO: 78205 - DNA, 15 bp, Artificial Sequence
  dgRNA
  2610528A11Rik
ttatcctgttgggag

SEQ ID NO: 78206 - DNA, 15 bp, Artificial Sequence
  dgRNA
  Gabrb3
ccttccccgggagtc

SEQ ID NO: 78207 - DNA, 15 bp, Artificial Sequence
  dgRNA
  Gabrb3
cccgggagtccggtg

SEQ ID NO: 78208 - DNA, 15 bp, Artificial Sequence
  dgRNA
  Gabrb3
gtgcggccgctgccg

SEQ ID NO: 78209 - DNA, 15 bp, Artificial Sequence
  dgRNA
  Gabrb3
gccgctgccgcggct

SEQ ID NO: 78210 - DNA, 15 bp, Artificial Sequence
  dgRNA
  Epm2aip1
gtccgctcttcctat

SEQ ID NO: 78211 - DNA, 15 bp, Artificial Sequence
  dgRNA
  Epm2aip1
agccaataggaacgg

SEQ ID NO: 78212 - DNA, 15 bp, Artificial Sequence
  dgRNA
  Epm2aip1
ggaacggaggtgccc

SEQ ID NO: 78213 - DNA, 15 bp, Artificial Sequence
  dgRNA
  Epm2aip1
acggaggtgccctgg

SEQ ID NO: 78214 - DNA, 15 bp, Artificial Sequence
  dgRNA
  Cyb5a
cgcctccccacccaa

SEQ ID NO: 78215 - DNA, 15 bp, Artificial Sequence
  dgRNA
  Cyb5a
atcaacaccacgcgc

SEQ ID NO: 78216 - DNA, 15 bp, Artificial Sequence
  dgRNA
  Cyb5a
ccacgcgccgggctg

SEQ ID NO: 78217 - DNA, 15 bp, Artificial Sequence
  dgRNA
  Cyb5a
gcgccgggctgtggt

SEQ ID NO: 78218 - DNA, 15 bp, Artificial Sequence
  dgRNA
  Olfr161
gctagctatgctgtt

SEQ ID NO: 78219 - DNA, 15 bp, Artificial Sequence
  dgRNA
  Olfr161
tatgctgttggggct

SEQ ID NO: 78220 - DNA, 15 bp, Artificial Sequence
  dgRNA
  Olfr161
aactgcaacaaggct

SEQ ID NO: 78221 - DNA, 15 bp, Artificial Sequence
  dgRNA
  Olfr161
aaactgcaacaaggc

SEQ ID NO: 78222 - DNA, 15 bp, Artificial Sequence
  dgRNA
  Stat5a
taaaatgatccctcc

SEQ ID NO: 78223 - DNA, 15 bp, Artificial Sequence
  dgRNA
  Stat5a
gggtcttggcccgga

SEQ ID NO: 78224 - DNA, 15 bp, Artificial Sequence
  dgRNA
  Stat5a
ggatggtattcgagt

SEQ ID NO: 78225 - DNA, 15 bp, Artificial Sequence
  dgRNA
  Stat5a
ttcgagtaggcagcc

SEQ ID NO: 78226 - DNA, 15 bp, Artificial Sequence
  dgRNA
  Ptger1
agttttgcccactca

SEQ ID NO: 78227 - DNA, 15 bp, Artificial Sequence
  dgRNA
  Ptger1
ccagtgaagtgcggg

SEQ ID NO: 78228 - DNA, 15 bp, Artificial Sequence
  dgRNA
  Ptger1
ggcggcacggagccg

SEQ ID NO: 78229 - DNA, 15 bp, Artificial Sequence
  dgRNA
  Ptger1
gccgccccaggaaga

SEQ ID NO: 78230 - DNA, 15 bp, Artificial Sequence
  dgRNA
  Vmn1r225
cttcaatacatgcct

SEQ ID NO: 78231 - DNA, 15 bp, Artificial Sequence
  dgRNA
  Vmn1r225
attgaagcttataaa

SEQ ID NO: 78232 - DNA, 15 bp, Artificial Sequence
  dgRNA
  Trank1
gtcgcgaggaccacc

SEQ ID NO: 78233 - DNA, 15 bp, Artificial Sequence
  dgRNA
  Trank1
gcgaggaccacccgg

SEQ ID NO: 78234 - DNA, 15 bp, Artificial Sequence
  dgRNA
  Trank1
cgaggaccacccggc

SEQ ID NO: 78235 - DNA, 15 bp, Artificial Sequence
  dgRNA
  Trank1
gaggaccacccggcg

SEQ ID NO: 78236 - DNA, 15 bp, Artificial Sequence
  dgRNA
  Zfp692
tctcgcggttcagaa

SEQ ID NO: 78237 - DNA, 15 bp, Artificial Sequence
  dgRNA
  Zfp692
ctagttggcttcagc

SEQ ID NO: 78238 - DNA, 15 bp, Artificial Sequence
  dgRNA
  Zfp692
cagctcgcgtttgct

SEQ ID NO: 78239 - DNA, 15 bp, Artificial Sequence
  dgRNA
  Zfp692
ctcgcgtttgcttgg

SEQ ID NO: 78240 - DNA, 15 bp, Artificial Sequence
  dgRNA
  Emilin3
agccgcgagtagccc

SEQ ID NO: 78241 - DNA, 15 bp, Artificial Sequence
  dgRNA
  Emilin3
ggctactcgcggctg

SEQ ID NO: 78242 - DNA, 15 bp, Artificial Sequence
  dgRNA
  Emilin3
gggctactcgcggct

SEQ ID NO: 78243 - DNA, 15 bp, Artificial Sequence
  dgRNA
  Emilin3
ggggctactcgcggc

SEQ ID NO: 78244 - DNA, 15 bp, Artificial Sequence
  dgRNA
  Ctgf
agctttttcagacgg

SEQ ID NO: 78245 - DNA, 15 bp, Artificial Sequence
  dgRNA
  Ctgf
aatgtggagtgtcaa

SEQ ID NO: 78246 - DNA, 15 bp, Artificial Sequence
  dgRNA
  Ctgf
atgtggagtgtcaag

SEQ ID NO: 78247 - DNA, 15 bp, Artificial Sequence
  dgRNA
  Ctgf
gagtgtcaaggggtc

SEQ ID NO: 78248 - DNA, 15 bp, Artificial Sequence
  dgRNA
  Gria1
ccggctcagttaatc

SEQ ID NO: 78249 - DNA, 15 bp, Artificial Sequence
  dgRNA
  Gria1
aatctggctgtcagt

SEQ ID NO: 78250 - DNA, 15 bp, Artificial Sequence
  dgRNA
  Gria1
tgcagtttaactgct

SEQ ID NO: 78251 - DNA, 15 bp, Artificial Sequence
  dgRNA
  Slx4ip
ctgcacctctaggtc

SEQ ID NO: 78252 - DNA, 15 bp, Artificial Sequence
  dgRNA
  Slx4ip
ccctgcgcggcaaga

SEQ ID NO: 78253 - DNA, 15 bp, Artificial Sequence
  dgRNA
  Slx4ip
ggtggcctgacctag

SEQ ID NO: 78254 - DNA, 15 bp, Artificial Sequence
  dgRNA
  Slx4ip
gcgatttctggtttc

SEQ ID NO: 78255 - DNA, 15 bp, Artificial Sequence
  dgRNA
  Rnf4
ccgctcgccaacccg

SEQ ID NO: 78256 - DNA, 15 bp, Artificial Sequence
  dgRNA
  Rnf4
cgccaacccgcggcc

SEQ ID NO: 78257 - DNA, 15 bp, Artificial Sequence
  dgRNA
  Rnf4
aacccgcggcctggc

SEQ ID NO: 78258 - DNA, 15 bp, Artificial Sequence
  dgRNA
  Rnf4
cctctttcgccaagt

SEQ ID NO: 78259 - DNA, 15 bp, Artificial Sequence
  dgRNA
  Bsx
tccctattggttcgc

SEQ ID NO: 78260 - DNA, 15 bp, Artificial Sequence
  dgRNA
  Bsx
ccctattggttcgcc

SEQ ID NO: 78261 - DNA, 15 bp, Artificial Sequence
  dgRNA
  Bsx
aacctaccccggcgc

SEQ ID NO: 78262 - DNA, 15 bp, Artificial Sequence
  dgRNA
  Bsx
caagaagacaagcgc

SEQ ID NO: 78263 - DNA, 15 bp, Artificial Sequence
  dgRNA
  Sdf4
cttcgagattcgtac

SEQ ID NO: 78264 - DNA, 15 bp, Artificial Sequence
  dgRNA
  Sdf4
cgagattcgtaccgg

SEQ ID NO: 78265 - DNA, 15 bp, Artificial Sequence
  dgRNA
  Sdf4
attcgtaccggaggc

SEQ ID NO: 78266 - DNA, 15 bp, Artificial Sequence
  dgRNA
  Sdf4
ttcgtaccggaggcc

SEQ ID NO: 78267 - DNA, 15 bp, Artificial Sequence
  dgRNA
  Ndrg2
ggggcgccgttgatg

SEQ ID NO: 78268 - DNA, 15 bp, Artificial Sequence
  dgRNA
  Ndrg2
gggcgccgttgatgt

SEQ ID NO: 78269 - DNA, 15 bp, Artificial Sequence
  dgRNA
  Ndrg2
ccgttgatgtgggcg

SEQ ID NO: 78270 - DNA, 15 bp, Artificial Sequence
  dgRNA
  Ndrg2
cgttgatgtgggcgt

SEQ ID NO: 78271 - DNA, 15 bp, Artificial Sequence
  dgRNA
  Ccdc88c
caggtctgcgcgcgc

SEQ ID NO: 78272 - DNA, 15 bp, Artificial Sequence
  dgRNA
  Ccdc88c
acctgcccgcgcact

SEQ ID NO: 78273 - DNA, 15 bp, Artificial Sequence
  dgRNA
  Ccdc88c
cctgcccgcgcactc

SEQ ID NO: 78274 - DNA, 15 bp, Artificial Sequence
  dgRNA
  Ccdc88c
ggccgccacgtgctg

SEQ ID NO: 78275 - DNA, 15 bp, Artificial Sequence
  dgRNA
  Krtdap
accttgcaagagctt

SEQ ID NO: 78276 - DNA, 15 bp, Artificial Sequence
  dgRNA
  Krtdap
cggagccccaggggt

SEQ ID NO: 78277 - DNA, 15 bp, Artificial Sequence
  dgRNA
  Krtdap
gtgggcgacatgatc

SEQ ID NO: 78278 - DNA, 15 bp, Artificial Sequence
  dgRNA
  Krtdap
tgggcgacatgatcc

SEQ ID NO: 78279 - DNA, 15 bp, Artificial Sequence
  dgRNA
  Vstm5
cttgaattgataaag

SEQ ID NO: 78280 - DNA, 15 bp, Artificial Sequence
  dgRNA
  Vstm5
ctagctgctgttcaa

SEQ ID NO: 78281 - DNA, 15 bp, Artificial Sequence
  dgRNA
  Vstm5
cactttatcaattca

SEQ ID NO: 78282 - DNA, 15 bp, Artificial Sequence
  dgRNA
  Vstm5
aaggcacgcactcag

SEQ ID NO: 78283 - DNA, 15 bp, Artificial Sequence
  dgRNA
  Rhebl1
atcccgctccacgtg

SEQ ID NO: 78284 - DNA, 15 bp, Artificial Sequence
  dgRNA
  Rhebl1
attctaatagaccaa

SEQ ID NO: 78285 - DNA, 15 bp, Artificial Sequence
  dgRNA
  Rhebl1
ttctaatagaccaat

SEQ ID NO: 78286 - DNA, 15 bp, Artificial Sequence
  dgRNA
  Rhebl1
catgtggggcggagc

SEQ ID NO: 78287 - DNA, 15 bp, Artificial Sequence
  dgRNA
  Srp72
tttggattaggagta

SEQ ID NO: 78288 - DNA, 15 bp, Artificial Sequence
  dgRNA
  Srp72
ttggattaggagtaa

SEQ ID NO: 78289 - DNA, 15 bp, Artificial Sequence
  dgRNA
  Srp72
aggagtaagggcgtc

SEQ ID NO: 78290 - DNA, 15 bp, Artificial Sequence
  dgRNA
  Srp72
ttctgacgctagctc

SEQ ID NO: 78291 - DNA, 15 bp, Artificial Sequence
  dgRNA
  Myo5c
gagcgggaacttggg

SEQ ID NO: 78292 - DNA, 15 bp, Artificial Sequence
  dgRNA
  Myo5c
agcgggaacttgggc

SEQ ID NO: 78293 - DNA, 15 bp, Artificial Sequence
  dgRNA
  Myo5c
gggcgggacccctgg

SEQ ID NO: 78294 - DNA, 15 bp, Artificial Sequence
  dgRNA
  Myo5c
ctttgacctgttacc

SEQ ID NO: 78295 - DNA, 15 bp, Artificial Sequence
  dgRNA
  Azi2
cactccgcctccccg

SEQ ID NO: 78296 - DNA, 15 bp, Artificial Sequence
  dgRNA
  Azi2
ccgcctccccgcggc

SEQ ID NO: 78297 - DNA, 15 bp, Artificial Sequence
  dgRNA
  Azi2
cgcctccccgcggct

SEQ ID NO: 78298 - DNA, 15 bp, Artificial Sequence
  dgRNA
  Azi2
gacagcgtcgcaggc

SEQ ID NO: 78299 - DNA, 15 bp, Artificial Sequence
  dgRNA
  Gm15800
agggtggtcttctcc

SEQ ID NO: 78300 - DNA, 15 bp, Artificial Sequence
  dgRNA
  Gm15800
gatagcatgggaagc

SEQ ID NO: 78301 - DNA, 15 bp, Artificial Sequence
  dgRNA
  Gm15800
gcaggggtgcccaag

SEQ ID NO: 78302 - DNA, 15 bp, Artificial Sequence
  dgRNA
  Gm15800
tgagcgccttgcagc

SEQ ID NO: 78303 - DNA, 15 bp, Artificial Sequence
  dgRNA
  Rpain
agcctatcaaagtgt

SEQ ID NO: 78304 - DNA, 15 bp, Artificial Sequence
  dgRNA
  Rpain
ggaatctcgagaagt

SEQ ID NO: 78305 - DNA, 15 bp, Artificial Sequence
  dgRNA
  Rpain
agaaagaatcgctag

SEQ ID NO: 78306 - DNA, 15 bp, Artificial Sequence
  dgRNA
  Rpain
cgctagaggatagac

SEQ ID NO: 78307 - DNA, 15 bp, Artificial Sequence
  dgRNA
  Stra13
gcattgcggaaggca

SEQ ID NO: 78308 - DNA, 15 bp, Artificial Sequence
  dgRNA
  Stra13
aaggcgggcttgagc

SEQ ID NO: 78309 - DNA, 15 bp, Artificial Sequence
  dgRNA
  Stra13
actcaagtcccggct

SEQ ID NO: 78310 - DNA, 15 bp, Artificial Sequence
  dgRNA
  Stra13
tcaagtcccggcttg

SEQ ID NO: 78311 - DNA, 15 bp, Artificial Sequence
  dgRNA
  Abcb10
ctgccgaccgcacga

SEQ ID NO: 78312 - DNA, 15 bp, Artificial Sequence
  dgRNA
  Abcb10
accgcacgaaggcga

SEQ ID NO: 78313 - DNA, 15 bp, Artificial Sequence
  dgRNA
  Abcb10
ggcgaaggcacccaa

SEQ ID NO: 78314 - DNA, 15 bp, Artificial Sequence
  dgRNA
  Abcb10
tcaagcaagagactc

SEQ ID NO: 78315 - DNA, 15 bp, Artificial Sequence
  dgRNA
  Rabac1
aacgacagctctgca

SEQ ID NO: 78316 - DNA, 15 bp, Artificial Sequence
  dgRNA
  Rabac1
gctctgcacggtcca

SEQ ID NO: 78317 - DNA, 15 bp, Artificial Sequence
  dgRNA
  Rabac1
ccaagatgtcttgcg

SEQ ID NO: 78318 - DNA, 15 bp, Artificial Sequence
  dgRNA
  Rabac1
gcagagctgtcgttc

SEQ ID NO: 78319 - DNA, 15 bp, Artificial Sequence
  dgRNA
  Usp4
gttacgtgcgtgcgt

SEQ ID NO: 78320 - DNA, 15 bp, Artificial Sequence
  dgRNA
  Usp4
agcacgccgtgcgct

SEQ ID NO: 78321 - DNA, 15 bp, Artificial Sequence
  dgRNA
  Usp4
acgccgtgcgctagg

SEQ ID NO: 78322 - DNA, 15 bp, Artificial Sequence
  dgRNA
  Usp4
cgctaggcggatgtc

SEQ ID NO: 78323 - DNA, 15 bp, Artificial Sequence
  dgRNA
  Olfr1206
taagtgatatctcac

SEQ ID NO: 78324 - DNA, 15 bp, Artificial Sequence
  dgRNA
  Cfap53
aaggttttttaggtc

SEQ ID NO: 78325 - DNA, 15 bp, Artificial Sequence
  dgRNA
  Cfap53
atcccatctatcttt

SEQ ID NO: 78326 - DNA, 15 bp, Artificial Sequence
  dgRNA
  Cfap53
cccatctatcttttg

SEQ ID NO: 78327 - DNA, 15 bp, Artificial Sequence
  dgRNA
  Cfap53
ccatctatcttttgg

SEQ ID NO: 78328 - DNA, 15 bp, Artificial Sequence
  dgRNA
  Chst3
ggacgcagctaagtc

SEQ ID NO: 78329 - DNA, 15 bp, Artificial Sequence
  dgRNA
  Chst3
ctaagtcgggaacaa

SEQ ID NO: 78330 - DNA, 15 bp, Artificial Sequence
  dgRNA
  Chst3
aacaaaggcccacgg

SEQ ID NO: 78331 - DNA, 15 bp, Artificial Sequence
  dgRNA
  Chst3
caaaggcccacggag

SEQ ID NO: 78332 - DNA, 15 bp, Artificial Sequence
  dgRNA
  Dnajc7
tgccttataaactcc

SEQ ID NO: 78333 - DNA, 15 bp, Artificial Sequence
  dgRNA
  Dnajc7
gccttataaactccg

SEQ ID NO: 78334 - DNA, 15 bp, Artificial Sequence
  dgRNA
  Dnajc7
tataaactccggggc

SEQ ID NO: 78335 - DNA, 15 bp, Artificial Sequence
  dgRNA
  Dnajc7
taaactccggggcag

SEQ ID NO: 78336 - DNA, 15 bp, Artificial Sequence
  dgRNA
  Igsf21
aataaatcggcttag

SEQ ID NO: 78337 - DNA, 15 bp, Artificial Sequence
  dgRNA
  Igsf21
ccgaacagcccagaa

SEQ ID NO: 78338 - DNA, 15 bp, Artificial Sequence
  dgRNA
  Igsf21
gcagcgagcgcagcg

SEQ ID NO: 78339 - DNA, 15 bp, Artificial Sequence
  dgRNA
  Igsf21
cagcgagcgcagcgc

SEQ ID NO: 78340 - DNA, 15 bp, Artificial Sequence
  dgRNA
  Cdc25a
cgcccccaccgagag

SEQ ID NO: 78341 - DNA, 15 bp, Artificial Sequence
  dgRNA
  Cdc25a
gcccccaccgagaga

SEQ ID NO: 78342 - DNA, 15 bp, Artificial Sequence
  dgRNA
  Cdc25a
gagggcgtgacctcg

SEQ ID NO: 78343 - DNA, 15 bp, Artificial Sequence
  dgRNA
  Cdc25a
ggcgtgacctcgagg

SEQ ID NO: 78344 - DNA, 15 bp, Artificial Sequence
  dgRNA
  Gatsl2
aaatcttgcattccc

SEQ ID NO: 78345 - DNA, 15 bp, Artificial Sequence
  dgRNA
  Gatsl2
aatcttgcattccca

SEQ ID NO: 78346 - DNA, 15 bp, Artificial Sequence
  dgRNA
  Gatsl2
attcccagggcaccg

SEQ ID NO: 78347 - DNA, 15 bp, Artificial Sequence
  dgRNA
  Gatsl2
agctggagtagtccg

SEQ ID NO: 78348 - DNA, 15 bp, Artificial Sequence
  dgRNA
  Tmem182
cgtctctttatagtc

SEQ ID NO: 78349 - DNA, 15 bp, Artificial Sequence
  dgRNA
  Tmem182
attttttgatcccca

SEQ ID NO: 78350 - DNA, 15 bp, Artificial Sequence
  dgRNA
  Tmem182
cttggagcccctcca

SEQ ID NO: 78351 - DNA, 15 bp, Artificial Sequence
  dgRNA
  Tmem182
ggtaatccatacaag

SEQ ID NO: 78352 - DNA, 15 bp, Artificial Sequence
  dgRNA
  Adamts16
gggtcataggcgtga

SEQ ID NO: 78353 - DNA, 15 bp, Artificial Sequence
  dgRNA
  Adamts16
cgcctatgacccagc

SEQ ID NO: 78354 - DNA, 15 bp, Artificial Sequence
  dgRNA
  Adamts16
actcatggtaagtac

SEQ ID NO: 78355 - DNA, 15 bp, Artificial Sequence
  dgRNA
  Lce1g
gggaatcacttggca

SEQ ID NO: 78356 - DNA, 15 bp, Artificial Sequence
  dgRNA
  Lce1g
cttagggcattgctt

SEQ ID NO: 78357 - DNA, 15 bp, Artificial Sequence
  dgRNA
  Bst2
ttctaggggcattcc

SEQ ID NO: 78358 - DNA, 15 bp, Artificial Sequence
  dgRNA
  Bst2
tagcagtttgcaacc

SEQ ID NO: 78359 - DNA, 15 bp, Artificial Sequence
  dgRNA
  Bst2
cagtttgcaacccgg

SEQ ID NO: 78360 - DNA, 15 bp, Artificial Sequence
  dgRNA
  Bst2
gctctagaattgcgt

SEQ ID NO: 78361 - DNA, 15 bp, Artificial Sequence
  dgRNA
  Cyb5r1
ggcatttcaattgtc

SEQ ID NO: 78362 - DNA, 15 bp, Artificial Sequence
  dgRNA
  Cyb5r1
gcaaagtagcctgtt

SEQ ID NO: 78363 - DNA, 15 bp, Artificial Sequence
  dgRNA
  Cyb5r1
ttttaagcctgtgcg

SEQ ID NO: 78364 - DNA, 15 bp, Artificial Sequence
  dgRNA
  Cyb5r1
tcatgctaattagcc

SEQ ID NO: 78365 - DNA, 15 bp, Artificial Sequence
  dgRNA
  Dtd2
ttcgaggatgagatt

SEQ ID NO: 78366 - DNA, 15 bp, Artificial Sequence
  dgRNA
  Dtd2
agattaggttaaaga

SEQ ID NO: 78367 - DNA, 15 bp, Artificial Sequence
  dgRNA
  Dtd2
ggtcaattccacatc

SEQ ID NO: 78368 - DNA, 15 bp, Artificial Sequence
  dgRNA
  Dtd2
gtcaattccacatcc

SEQ ID NO: 78369 - DNA, 15 bp, Artificial Sequence
  dgRNA
  Fndc4
ggctaatttcatgcg

SEQ ID NO: 78370 - DNA, 15 bp, Artificial Sequence
  dgRNA
  Fndc4
aatttcatgcgggga

SEQ ID NO: 78371 - DNA, 15 bp, Artificial Sequence
  dgRNA
  Fndc4
ttcatgcggggaagg

SEQ ID NO: 78372 - DNA, 15 bp, Artificial Sequence
  dgRNA
  Fndc4
ctctagtcagttaat

SEQ ID NO: 78373 - DNA, 15 bp, Artificial Sequence
  dgRNA
  Ap4m1
cagaaaacgaacgcg

SEQ ID NO: 78374 - DNA, 15 bp, Artificial Sequence
  dgRNA
  Ap4m1
aaaacgaacgcgcgg

SEQ ID NO: 78375 - DNA, 15 bp, Artificial Sequence
  dgRNA
  Ap4m1
aaacgaacgcgcggc

SEQ ID NO: 78376 - DNA, 15 bp, Artificial Sequence
  dgRNA
  Ap4m1
gcggcgggacgtagc

SEQ ID NO: 78377 - DNA, 15 bp, Artificial Sequence
  dgRNA
  Nup98
acgttcggtttcaaa

SEQ ID NO: 78378 - DNA, 15 bp, Artificial Sequence
  dgRNA
  Nup98
caatgaataacggtg

SEQ ID NO: 78379 - DNA, 15 bp, Artificial Sequence
  dgRNA
  Nup98
aatgaataacggtgt

SEQ ID NO: 78380 - DNA, 15 bp, Artificial Sequence
  dgRNA
  Nup98
ggtgtgggcctcgag

SEQ ID NO: 78381 - DNA, 15 bp, Artificial Sequence
  dgRNA
  Hnrnpa0
gagcggcggtcgccg

SEQ ID NO: 78382 - DNA, 15 bp, Artificial Sequence
  dgRNA
  Hnrnpa0
tcgccgaggagcccc

SEQ ID NO: 78383 - DNA, 15 bp, Artificial Sequence
  dgRNA
  Hnrnpa0
gccccaggcccggac

SEQ ID NO: 78384 - DNA, 15 bp, Artificial Sequence
  dgRNA
  Hnrnpa0
ccccaggcccggacc

SEQ ID NO: 78385 - DNA, 15 bp, Artificial Sequence
  dgRNA
  Taf15
tcccctagccccagg

SEQ ID NO: 78386 - DNA, 15 bp, Artificial Sequence
  dgRNA
  Taf15
attccctctcaataa

SEQ ID NO: 78387 - DNA, 15 bp, Artificial Sequence
  dgRNA
  Taf15
ctctcaataatggta

SEQ ID NO: 78388 - DNA, 15 bp, Artificial Sequence
  dgRNA
  Taf15
ataatggtacggtcg

SEQ ID NO: 78389 - DNA, 15 bp, Artificial Sequence
  dgRNA
  Pdk1
ggcggccactcgctc

SEQ ID NO: 78390 - DNA, 15 bp, Artificial Sequence
  dgRNA
  Pdk1
gcggccactcgctcc

SEQ ID NO: 78391 - DNA, 15 bp, Artificial Sequence
  dgRNA
  Pdk1
gccactcgctccggg

SEQ ID NO: 78392 - DNA, 15 bp, Artificial Sequence
  dgRNA
  Pdk1
gggccccgcctacat

SEQ ID NO: 78393 - DNA, 15 bp, Artificial Sequence
  dgRNA
  Fut7
ctaaaagctttgtat

SEQ ID NO: 78394 - DNA, 15 bp, Artificial Sequence
  dgRNA
  Fut7
tgggccaccctaccc

SEQ ID NO: 78395 - DNA, 15 bp, Artificial Sequence
  dgRNA
  Fut7
caccctaccctggtc

SEQ ID NO: 78396 - DNA, 15 bp, Artificial Sequence
  dgRNA
  Fut7
accctaccctggtct

SEQ ID NO: 78397 - DNA, 15 bp, Artificial Sequence
  dgRNA
  Ak1
cctaaggaggcagtt

SEQ ID NO: 78398 - DNA, 15 bp, Artificial Sequence
  dgRNA
  Ak1
ctaaggaggcagttt

SEQ ID NO: 78399 - DNA, 15 bp, Artificial Sequence
  dgRNA
  Ak1
tatggcaacacgttg

SEQ ID NO: 78400 - DNA, 15 bp, Artificial Sequence
  dgRNA
  Ak1
tgccacagtactgct

SEQ ID NO: 78401 - DNA, 15 bp, Artificial Sequence
  dgRNA
  Sart3
aggcgcagagcggga

SEQ ID NO: 78402 - DNA, 15 bp, Artificial Sequence
  dgRNA
  Sart3
cgggaaggtccgaag

SEQ ID NO: 78403 - DNA, 15 bp, Artificial Sequence
  dgRNA
  Sart3
ccgaagcggcgtgca

SEQ ID NO: 78404 - DNA, 15 bp, Artificial Sequence
  dgRNA
  Sart3
gcgtgcaaggttgtc

SEQ ID NO: 78405 - DNA, 15 bp, Artificial Sequence
  dgRNA
  Vmn2r124
gcattctcaatacct

SEQ ID NO: 78406 - DNA, 15 bp, Artificial Sequence
  dgRNA
  Rap2c
cccccaaccgtcgct

SEQ ID NO: 78407 - DNA, 15 bp, Artificial Sequence
  dgRNA
  Rap2c
cgctcggacgctcgc

SEQ ID NO: 78408 - DNA, 15 bp, Artificial Sequence
  dgRNA
  Rap2c
gccctgggttcctat

SEQ ID NO: 78409 - DNA, 15 bp, Artificial Sequence
  dgRNA
  Rap2c
tgggttcctatagga

SEQ ID NO: 78410 - DNA, 15 bp, Artificial Sequence
  dgRNA
  Cnr2
ggtcaagtgagttgc

SEQ ID NO: 78411 - DNA, 15 bp, Artificial Sequence
  dgRNA
  Cnr2
ggacagcatacaccc

SEQ ID NO: 78412 - DNA, 15 bp, Artificial Sequence
  dgRNA
  Cnr2
gacagcatacacccg

SEQ ID NO: 78413 - DNA, 15 bp, Artificial Sequence
  dgRNA
  Cnr2
agagaattcaaccgc

SEQ ID NO: 78414 - DNA, 15 bp, Artificial Sequence
  dgRNA
  Coq4
gttataaataacgcc

SEQ ID NO: 78415 - DNA, 15 bp, Artificial Sequence
  dgRNA
  Coq4
cctccgtagtacctg

SEQ ID NO: 78416 - DNA, 15 bp, Artificial Sequence
  dgRNA
  Coq4
cgttatttataacgt

SEQ ID NO: 78417 - DNA, 15 bp, Artificial Sequence
  dgRNA
  Coq4
tgttgtaatatggac

SEQ ID NO: 78418 - DNA, 15 bp, Artificial Sequence
  dgRNA
  Mmp24
gccctctttgcaccc

SEQ ID NO: 78419 - DNA, 15 bp, Artificial Sequence
  dgRNA
  Mmp24
ccctctttgcacccg

SEQ ID NO: 78420 - DNA, 15 bp, Artificial Sequence
  dgRNA
  Mmp24
tttgcacccggggcc

SEQ ID NO: 78421 - DNA, 15 bp, Artificial Sequence
  dgRNA
  Mmp24
cccgcaggtcccgtt

SEQ ID NO: 78422 - DNA, 15 bp, Artificial Sequence
  dgRNA
  Xpot
ggagttgtagtcccc

SEQ ID NO: 78423 - DNA, 15 bp, Artificial Sequence
  dgRNA
  Xpot
gagttgtagtccccc

SEQ ID NO: 78424 - DNA, 15 bp, Artificial Sequence
  dgRNA
  Xpot
aggctgctgctagcg

SEQ ID NO: 78425 - DNA, 15 bp, Artificial Sequence
  dgRNA
  Xpot
ggctgctgctagcgc

SEQ ID NO: 78426 - DNA, 15 bp, Artificial Sequence
  dgRNA
  Ndufb3
tcaccccgcagcctc

SEQ ID NO: 78427 - DNA, 15 bp, Artificial Sequence
  dgRNA
  Ndufb3
aacaaccgctctcat

SEQ ID NO: 78428 - DNA, 15 bp, Artificial Sequence
  dgRNA
  Ndufb3
gctgcgctatgactt

SEQ ID NO: 78429 - DNA, 15 bp, Artificial Sequence
  dgRNA
  Ndufb3
ctttggcccgcctct

SEQ ID NO: 78430 - DNA, 15 bp, Artificial Sequence
  dgRNA
  Gm17689
taggtactgaaatat

SEQ ID NO: 78431 - DNA, 15 bp, Artificial Sequence
  dgRNA
  Gm17689
tagttgtgtattgac

SEQ ID NO: 78432 - DNA, 15 bp, Artificial Sequence
  dgRNA
  Pdgfa
gccgagagtccagac

SEQ ID NO: 78433 - DNA, 15 bp, Artificial Sequence
  dgRNA
  Pdgfa
cagacaggtgatcgg

SEQ ID NO: 78434 - DNA, 15 bp, Artificial Sequence
  dgRNA
  Pdgfa
aggtgatcggtggtg

SEQ ID NO: 78435 - DNA, 15 bp, Artificial Sequence
  dgRNA
  Pdgfa
tgatcggtggtgcgg

SEQ ID NO: 78436 - DNA, 15 bp, Artificial Sequence
  dgRNA
  Prl7a2
agcagtatgttgccc

SEQ ID NO: 78437 - DNA, 15 bp, Artificial Sequence
  dgRNA
  Prl7a2
gcagtatgttgccct

SEQ ID NO: 78438 - DNA, 15 bp, Artificial Sequence
  dgRNA
  Prl7a2
cagtatgttgccctg

SEQ ID NO: 78439 - DNA, 15 bp, Artificial Sequence
  dgRNA
  Prl7a2
ctggggatcgttcaa

SEQ ID NO: 78440 - DNA, 15 bp, Artificial Sequence
  dgRNA
  Klk11
taagattttctcccg

SEQ ID NO: 78441 - DNA, 15 bp, Artificial Sequence
  dgRNA
  Klk11
ctttacatgagaacc

SEQ ID NO: 78442 - DNA, 15 bp, Artificial Sequence
  dgRNA
  Klk11
gagtggcttggatct

SEQ ID NO: 78443 - DNA, 15 bp, Artificial Sequence
  dgRNA
  Dbi
tcccaacgtgccccg

SEQ ID NO: 78444 - DNA, 15 bp, Artificial Sequence
  dgRNA
  Dbi
tccgtcagggcagtt

SEQ ID NO: 78445 - DNA, 15 bp, Artificial Sequence
  dgRNA
  Dbi
ctccgtcagggcagt

SEQ ID NO: 78446 - DNA, 15 bp, Artificial Sequence
  dgRNA
  Dbi
ggacattctccgtca

SEQ ID NO: 78447 - DNA, 15 bp, Artificial Sequence
  dgRNA
  Usp6nl
gcccgtgagtagctc

SEQ ID NO: 78448 - DNA, 15 bp, Artificial Sequence
  dgRNA
  Usp6nl
ctctggagcgatcgc

SEQ ID NO: 78449 - DNA, 15 bp, Artificial Sequence
  dgRNA
  Usp6nl
tctggagcgatcgct

SEQ ID NO: 78450 - DNA, 15 bp, Artificial Sequence
  dgRNA
  Usp6nl
atcgctgggcgccgc

SEQ ID NO: 78451 - DNA, 15 bp, Artificial Sequence
  dgRNA
  Tmsb10
gccacgccctccgcg

SEQ ID NO: 78452 - DNA, 15 bp, Artificial Sequence
  dgRNA
  Tmsb10
gccctccgcgcgggc

SEQ ID NO: 78453 - DNA, 15 bp, Artificial Sequence
  dgRNA
  Tmsb10
gccacgccctcgttg

SEQ ID NO: 78454 - DNA, 15 bp, Artificial Sequence
  dgRNA
  Tmsb10
acgccctcgttgcgg

SEQ ID NO: 78455 - DNA, 15 bp, Artificial Sequence
  dgRNA
  Fam208a
cgtcgacgctttccc

SEQ ID NO: 78456 - DNA, 15 bp, Artificial Sequence
  dgRNA
  Fam208a
gtcgacgctttcccc

SEQ ID NO: 78457 - DNA, 15 bp, Artificial Sequence
  dgRNA
  Fam208a
cgctttccccgggcg

SEQ ID NO: 78458 - DNA, 15 bp, Artificial Sequence
  dgRNA
  Fam208a
ggcactctcctcttt

SEQ ID NO: 78459 - DNA, 15 bp, Artificial Sequence
  dgRNA
  Fgf22
ggtgacaaccggact

SEQ ID NO: 78460 - DNA, 15 bp, Artificial Sequence
  dgRNA
  Fgf22
gtgacaaccggacta

SEQ ID NO: 78461 - DNA, 15 bp, Artificial Sequence
  dgRNA
  Fgf22
cacagaacccgcaat

SEQ ID NO: 78462 - DNA, 15 bp, Artificial Sequence
  dgRNA
  Fgf22
ccgcaattggagtcg

SEQ ID NO: 78463 - DNA, 15 bp, Artificial Sequence
  dgRNA
  Enoph1
ccgggcctcccgcgc

SEQ ID NO: 78464 - DNA, 15 bp, Artificial Sequence
  dgRNA
  Enoph1
ggggctcgtgcagac

SEQ ID NO: 78465 - DNA, 15 bp, Artificial Sequence
  dgRNA
  Enoph1
cggggctcgtgcaga

SEQ ID NO: 78466 - DNA, 15 bp, Artificial Sequence
  dgRNA
  Enoph1
tgcgcgggaggcccg

SEQ ID NO: 78467 - DNA, 15 bp, Artificial Sequence
  dgRNA
  Snrpd2
caagaaaagtgtccg

SEQ ID NO: 78468 - DNA, 15 bp, Artificial Sequence
  dgRNA
  Snrpd2
aagaaaagtgtccga

SEQ ID NO: 78469 - DNA, 15 bp, Artificial Sequence
  dgRNA
  Snrpd2
gtgtccgagggtatt

SEQ ID NO: 78470 - DNA, 15 bp, Artificial Sequence
  dgRNA
  Snrpd2
aactggacggtttga

SEQ ID NO: 78471 - DNA, 15 bp, Artificial Sequence
  dgRNA
  Tnks2
tctcgtttttagcag

SEQ ID NO: 78472 - DNA, 15 bp, Artificial Sequence
  dgRNA
  Tnks2
tgtaaagatggcggt

SEQ ID NO: 78473 - DNA, 15 bp, Artificial Sequence
  dgRNA
  Tnks2
tctttccgcagccaa

SEQ ID NO: 78474 - DNA, 15 bp, Artificial Sequence
  dgRNA
  Tnks2
acaaacccctccgcg

SEQ ID NO: 78475 - DNA, 15 bp, Artificial Sequence
  dgRNA
  Bbs7
ctccaagcagatcgc

SEQ ID NO: 78476 - DNA, 15 bp, Artificial Sequence
  dgRNA
  Bbs7
agatcgctggcccag

SEQ ID NO: 78477 - DNA, 15 bp, Artificial Sequence
  dgRNA
  Bbs7
gcagagaatgcgccc

SEQ ID NO: 78478 - DNA, 15 bp, Artificial Sequence
  dgRNA
  Bbs7
gcgccccggttgcct

SEQ ID NO: 78479 - DNA, 15 bp, Artificial Sequence
  dgRNA
  Brap
cggcgctgccgaccg

SEQ ID NO: 78480 - DNA, 15 bp, Artificial Sequence
  dgRNA
  Brap
ggcgctgccgaccgc

SEQ ID NO: 78481 - DNA, 15 bp, Artificial Sequence
  dgRNA
  Brap
cgaccgcgggccgct

SEQ ID NO: 78482 - DNA, 15 bp, Artificial Sequence
  dgRNA
  Brap
gggccgctcggcctc

SEQ ID NO: 78483 - DNA, 15 bp, Artificial Sequence
  dgRNA
  Itgb6
accgatttaaatgta

SEQ ID NO: 78484 - DNA, 15 bp, Artificial Sequence
  dgRNA
  Itgb6
gtgcccgggaaggtg

SEQ ID NO: 78485 - DNA, 15 bp, Artificial Sequence
  dgRNA
  Itgb6
agtgcccgggaaggt

SEQ ID NO: 78486 - DNA, 15 bp, Artificial Sequence
  dgRNA
  Itgb6
cagtgcccgggaagg

SEQ ID NO: 78487 - DNA, 15 bp, Artificial Sequence
  dgRNA
  Slc27a5
gctggtggtgtccaa

SEQ ID NO: 78488 - DNA, 15 bp, Artificial Sequence
  dgRNA
  Slc27a5
ctggtggtgtccaag

SEQ ID NO: 78489 - DNA, 15 bp, Artificial Sequence
  dgRNA
  Slc27a5
gcaggccgggtgatc

SEQ ID NO: 78490 - DNA, 15 bp, Artificial Sequence
  dgRNA
  Slc27a5
gccgggtgatccggc

SEQ ID NO: 78491 - DNA, 15 bp, Artificial Sequence
  dgRNA
  Cldn3
ttctcctatggtgaa

SEQ ID NO: 78492 - DNA, 15 bp, Artificial Sequence
  dgRNA
  Cldn3
gaggacggaccggac

SEQ ID NO: 78493 - DNA, 15 bp, Artificial Sequence
  dgRNA
  Cldn3
acggaccggactgga

SEQ ID NO: 78494 - DNA, 15 bp, Artificial Sequence
  dgRNA
  Cldn3
cggaccggactggac

SEQ ID NO: 78495 - DNA, 15 bp, Artificial Sequence
  dgRNA
  Olfr740
tttaaacccccattc

SEQ ID NO: 78496 - DNA, 15 bp, Artificial Sequence
  dgRNA
  Olfr740
taactactggatatc

SEQ ID NO: 78497 - DNA, 15 bp, Artificial Sequence
  dgRNA
  Olfr740
aatgtttgcccagac

SEQ ID NO: 78498 - DNA, 15 bp, Artificial Sequence
  dgRNA
  Nxpe4
gaatgtcttatcacg

SEQ ID NO: 78499 - DNA, 15 bp, Artificial Sequence
  dgRNA
  Nxpe4
actccataggcatgc

SEQ ID NO: 78500 - DNA, 15 bp, Artificial Sequence
  dgRNA
  Nxpe4
tttcaggcactccat

SEQ ID NO: 78501 - DNA, 15 bp, Artificial Sequence
  dgRNA
  Arid3a
agggggaccccggtg

SEQ ID NO: 78502 - DNA, 15 bp, Artificial Sequence
  dgRNA
  Arid3a
cccggtgtggtgtcc

SEQ ID NO: 78503 - DNA, 15 bp, Artificial Sequence
  dgRNA
  Arid3a
gctgaatcaccggcg

SEQ ID NO: 78504 - DNA, 15 bp, Artificial Sequence
  dgRNA
  Arid3a
gagcaatttgtcaca

SEQ ID NO: 78505 - DNA, 15 bp, Artificial Sequence
  dgRNA
  Atg10
ggggttgcccctgcc

SEQ ID NO: 78506 - DNA, 15 bp, Artificial Sequence
  dgRNA
  Atg10
gccgagagcaccaag

SEQ ID NO: 78507 - DNA, 15 bp, Artificial Sequence
  dgRNA
  Atg10
ccgagagcaccaagc

SEQ ID NO: 78508 - DNA, 15 bp, Artificial Sequence
  dgRNA
  Atg10
agcaccaagcgggtt

SEQ ID NO: 78509 - DNA, 15 bp, Artificial Sequence
  dgRNA
  Psg25
ataacaactcatcca

SEQ ID NO: 78510 - DNA, 15 bp, Artificial Sequence
  dgRNA
  Uqcrb
gtgtggagtccattc

SEQ ID NO: 78511 - DNA, 15 bp, Artificial Sequence
  dgRNA
  Uqcrb
tcaatgctctgttat

SEQ ID NO: 78512 - DNA, 15 bp, Artificial Sequence
  dgRNA
  Uqcrb
aagtactgcgaaatt

SEQ ID NO: 78513 - DNA, 15 bp, Artificial Sequence
  dgRNA
  Uqcrb
cttcgcgacacaatg

SEQ ID NO: 78514 - DNA, 15 bp, Artificial Sequence
  dgRNA
  Esco1
gtattatttggccgc

SEQ ID NO: 78515 - DNA, 15 bp, Artificial Sequence
  dgRNA
  Esco1
tatttggccgcaggc

SEQ ID NO: 78516 - DNA, 15 bp, Artificial Sequence
  dgRNA
  Esco1
tttgagccatccaac

SEQ ID NO: 78517 - DNA, 15 bp, Artificial Sequence
  dgRNA
  Esco1
aactggccccaaagt

SEQ ID NO: 78518 - DNA, 15 bp, Artificial Sequence
  dgRNA
  Hrh4
gccaccacaagttga

SEQ ID NO: 78519 - DNA, 15 bp, Artificial Sequence
  dgRNA
  Hrh4
tggttatcaataacc

SEQ ID NO: 78520 - DNA, 15 bp, Artificial Sequence
  dgRNA
  Hrh4
ataaccatcaacttg

SEQ ID NO: 78521 - DNA, 15 bp, Artificial Sequence
  dgRNA
  Nfkbid
ttttaacggatgtgg

SEQ ID NO: 78522 - DNA, 15 bp, Artificial Sequence
  dgRNA
  Nfkbid
gtggtggtgcttccg

SEQ ID NO: 78523 - DNA, 15 bp, Artificial Sequence
  dgRNA
  Nfkbid
ggagcccggtgtctc

SEQ ID NO: 78524 - DNA, 15 bp, Artificial Sequence
  dgRNA
  Nfkbid
cagtttccactacgg

SEQ ID NO: 78525 - DNA, 15 bp, Artificial Sequence
  dgRNA
  Olfr630
actgcaatgccttga

SEQ ID NO: 78526 - DNA, 15 bp, Artificial Sequence
  dgRNA
  Olfr630
taacgaacaatgaaa

SEQ ID NO: 78527 - DNA, 15 bp, Artificial Sequence
  dgRNA
  Olfr630
atatgtaagcgctaa

SEQ ID NO: 78528 - DNA, 15 bp, Artificial Sequence
  dgRNA
  Trappc6b
cacccaccgtagagc

SEQ ID NO: 78529 - DNA, 15 bp, Artificial Sequence
  dgRNA
  Trappc6b
cgtagagcaggacgc

SEQ ID NO: 78530 - DNA, 15 bp, Artificial Sequence
  dgRNA
  Trappc6b
taatcctagcgtcct

SEQ ID NO: 78531 - DNA, 15 bp, Artificial Sequence
  dgRNA
  Trappc6b
ataatcctagcgtcc

SEQ ID NO: 78532 - DNA, 15 bp, Artificial Sequence
  dgRNA
  Crym
cagttggctaattac

SEQ ID NO: 78533 - DNA, 15 bp, Artificial Sequence
  dgRNA
  Crym
ggctaattacaggaa

SEQ ID NO: 78534 - DNA, 15 bp, Artificial Sequence
  dgRNA
  Crym
gctaattacaggaat

SEQ ID NO: 78535 - DNA, 15 bp, Artificial Sequence
  dgRNA
  Crym
gccaactgacattcc

SEQ ID NO: 78536 - DNA, 15 bp, Artificial Sequence
  dgRNA
  Cyp2c37
gccgcataaaaagca

SEQ ID NO: 78537 - DNA, 15 bp, Artificial Sequence
  dgRNA
  Cyp2c37
ctttgctacaatact

SEQ ID NO: 78538 - DNA, 15 bp, Artificial Sequence
  dgRNA
  Cyp2c37
caattgattgcactt

SEQ ID NO: 78539 - DNA, 15 bp, Artificial Sequence
  dgRNA
  1700028P14Rik
gcaatcaggatagta

SEQ ID NO: 78540 - DNA, 15 bp, Artificial Sequence
  dgRNA
  1700028P14Rik
ccgttgacccctcct

SEQ ID NO: 78541 - DNA, 15 bp, Artificial Sequence
  dgRNA
  1700028P14Rik
gatttgtagttacct

SEQ ID NO: 78542 - DNA, 15 bp, Artificial Sequence
  dgRNA
  1700028P14Rik
ggatttgtagttacc

SEQ ID NO: 78543 - DNA, 15 bp, Artificial Sequence
  dgRNA
  Tmem126b
cgcccaacctccgcc

SEQ ID NO: 78544 - DNA, 15 bp, Artificial Sequence
  dgRNA
  Tmem126b
caacctccgcccggc

SEQ ID NO: 78545 - DNA, 15 bp, Artificial Sequence
  dgRNA
  Tmem126b
cctccgcccggctgg

SEQ ID NO: 78546 - DNA, 15 bp, Artificial Sequence
  dgRNA
  Tmem126b
ctccgcccggctgga

SEQ ID NO: 78547 - DNA, 15 bp, Artificial Sequence
  dgRNA
  Olfr1031
tactaatagactgat

SEQ ID NO: 78548 - DNA, 15 bp, Artificial Sequence
  dgRNA
  Olfr1031
actaatagactgata

SEQ ID NO: 78549 - DNA, 15 bp, Artificial Sequence
  dgRNA
  H2-DMb2
ttaaccgatgatgct

SEQ ID NO: 78550 - DNA, 15 bp, Artificial Sequence
  dgRNA
  H2-DMb2
ttaggaccccagatt

SEQ ID NO: 78551 - DNA, 15 bp, Artificial Sequence
  dgRNA
  H2-DMb2
atttggttgagtgag

SEQ ID NO: 78552 - DNA, 15 bp, Artificial Sequence
  dgRNA
  H2-DMb2
gggctgagtgactcg

SEQ ID NO: 78553 - DNA, 15 bp, Artificial Sequence
  dgRNA
  Fbxo47
tgaggctccgcccgc

SEQ ID NO: 78554 - DNA, 15 bp, Artificial Sequence
  dgRNA
  Fbxo47
gaggctccgcccgca

SEQ ID NO: 78555 - DNA, 15 bp, Artificial Sequence
  dgRNA
  Fbxo47
cgcccgcagggttcc

SEQ ID NO: 78556 - DNA, 15 bp, Artificial Sequence
  dgRNA
  Fbxo47
gcccgcagggttccc

SEQ ID NO: 78557 - DNA, 15 bp, Artificial Sequence
  dgRNA
  Nhs
ggagaggcctgcgcc

SEQ ID NO: 78558 - DNA, 15 bp, Artificial Sequence
  dgRNA
  Nhs
gagaggcctgcgccg

SEQ ID NO: 78559 - DNA, 15 bp, Artificial Sequence
  dgRNA
  Nhs
acctagacacacacg

SEQ ID NO: 78560 - DNA, 15 bp, Artificial Sequence
  dgRNA
  Nhs
cacgcccatttatat

SEQ ID NO: 78561 - DNA, 15 bp, Artificial Sequence
  dgRNA
  Mylk3
agtgcgagatagaca

SEQ ID NO: 78562 - DNA, 15 bp, Artificial Sequence
  dgRNA
  Mylk3
acattcctctttaag

SEQ ID NO: 78563 - DNA, 15 bp, Artificial Sequence
  dgRNA
  Fbxw17
acttcagtgatcgct

SEQ ID NO: 78564 - DNA, 15 bp, Artificial Sequence
  dgRNA
  Fbxw17
tcgctaggccagagc

SEQ ID NO: 78565 - DNA, 15 bp, Artificial Sequence
  dgRNA
  Fbxw17
tggggaggcgagcgc

SEQ ID NO: 78566 - DNA, 15 bp, Artificial Sequence
  dgRNA
  Fbxw17
aggcgagcgcaggag

SEQ ID NO: 78567 - DNA, 15 bp, Artificial Sequence
  dgRNA
  Pigs
tcgccttctctaaac

SEQ ID NO: 78568 - DNA, 15 bp, Artificial Sequence
  dgRNA
  Pigs
gcgcgtaccctctca

SEQ ID NO: 78569 - DNA, 15 bp, Artificial Sequence
  dgRNA
  Pigs
cgcgtaccctctcac

SEQ ID NO: 78570 - DNA, 15 bp, Artificial Sequence
  dgRNA
  Pigs
gctccgcctgcgcac

SEQ ID NO: 78571 - DNA, 15 bp, Artificial Sequence
  dgRNA
  Ankhd1
cgttcacaaccgcct

SEQ ID NO: 78572 - DNA, 15 bp, Artificial Sequence
  dgRNA
  Ankhd1
ccgcctaggcctacg

SEQ ID NO: 78573 - DNA, 15 bp, Artificial Sequence
  dgRNA
  Ankhd1
cgcctaggcctacgc

SEQ ID NO: 78574 - DNA, 15 bp, Artificial Sequence
  dgRNA
  Ankhd1
cgggtcaacgcagct

SEQ ID NO: 78575 - DNA, 15 bp, Artificial Sequence
  dgRNA
  Tas2r106
accaaaagccgttac

SEQ ID NO: 78576 - DNA, 15 bp, Artificial Sequence
  dgRNA
  Tas2r106
ccaaaagccgttact

SEQ ID NO: 78577 - DNA, 15 bp, Artificial Sequence
  dgRNA
  Tas2r106
gcaatattctgcagc

SEQ ID NO: 78578 - DNA, 15 bp, Artificial Sequence
  dgRNA
  Tas2r106
gcagaagcaacgtta

SEQ ID NO: 78579 - DNA, 15 bp, Artificial Sequence
  dgRNA
  Cish
ccatatcctgaaccg

SEQ ID NO: 78580 - DNA, 15 bp, Artificial Sequence
  dgRNA
  Cish
cctgaaccgtggatg

SEQ ID NO: 78581 - DNA, 15 bp, Artificial Sequence
  dgRNA
  Cish
gaaccgtggatgtgg

SEQ ID NO: 78582 - DNA, 15 bp, Artificial Sequence
  dgRNA
  Cish
aaccgtggatgtgga

SEQ ID NO: 78583 - DNA, 15 bp, Artificial Sequence
  dgRNA
  Tmbim6
ggtacgtgcgaaact

SEQ ID NO: 78584 - DNA, 15 bp, Artificial Sequence
  dgRNA
  Tmbim6
gtgcgaaactaggat

SEQ ID NO: 78585 - DNA, 15 bp, Artificial Sequence
  dgRNA
  Tmbim6
tgcgaaactaggatc

SEQ ID NO: 78586 - DNA, 15 bp, Artificial Sequence
  dgRNA
  Tmbim6
aggatcgggcaaacc

SEQ ID NO: 78587 - DNA, 15 bp, Artificial Sequence
  dgRNA
  Snx27
ctcatcatccaacca

SEQ ID NO: 78588 - DNA, 15 bp, Artificial Sequence
  dgRNA
  Stx17
actgtaacatgtaga

SEQ ID NO: 78589 - DNA, 15 bp, Artificial Sequence
  dgRNA
  Stx17
tacctccacgcccac

SEQ ID NO: 78590 - DNA, 15 bp, Artificial Sequence
  dgRNA
  Stx17
tccacgcccactggc

SEQ ID NO: 78591 - DNA, 15 bp, Artificial Sequence
  dgRNA
  Stx17
ccacgcccactggcc

SEQ ID NO: 78592 - DNA, 15 bp, Artificial Sequence
  dgRNA
  Uros
ccttccgccggcgcc

SEQ ID NO: 78593 - DNA, 15 bp, Artificial Sequence
  dgRNA
  Uros
ccaggcgccggcgga

SEQ ID NO: 78594 - DNA, 15 bp, Artificial Sequence
  dgRNA
  Uros
gcgtccaggcgccgg

SEQ ID NO: 78595 - DNA, 15 bp, Artificial Sequence
  dgRNA
  Uros
ggggcgtccaggcgc

SEQ ID NO: 78596 - DNA, 15 bp, Artificial Sequence
  dgRNA
  Ddx4
cctcggcctcaacaa

SEQ ID NO: 78597 - DNA, 15 bp, Artificial Sequence
  dgRNA
  Ddx4
cggcctcaacaaagg

SEQ ID NO: 78598 - DNA, 15 bp, Artificial Sequence
  dgRNA
  Ddx4
aggtggagaacgcgc

SEQ ID NO: 78599 - DNA, 15 bp, Artificial Sequence
  dgRNA
  Ddx4
caggccgtccgtcca

SEQ ID NO: 78600 - DNA, 15 bp, Artificial Sequence
  dgRNA
  Arid5b
aaaattgagtcttcg

SEQ ID NO: 78601 - DNA, 15 bp, Artificial Sequence
  dgRNA
  Arid5b
attgagacatcacgc

SEQ ID NO: 78602 - DNA, 15 bp, Artificial Sequence
  dgRNA
  Arid5b
tcaagccaacaagtt

SEQ ID NO: 78603 - DNA, 15 bp, Artificial Sequence
  dgRNA
  Arid5b
gattgcatcaggtcc

SEQ ID NO: 78604 - DNA, 15 bp, Artificial Sequence
  dgRNA
  4930402K13Rik
gactgtagtaaataa

SEQ ID NO: 78605 - DNA, 15 bp, Artificial Sequence
  dgRNA
  4930402K13Rik
tttgggtccatacta

SEQ ID NO: 78606 - DNA, 15 bp, Artificial Sequence
  dgRNA
  4930402K13Rik
aggagactgctggta

SEQ ID NO: 78607 - DNA, 15 bp, Artificial Sequence
  dgRNA
  4930402K13Rik
tcatagtagaatcca

SEQ ID NO: 78608 - DNA, 15 bp, Artificial Sequence
  dgRNA
  Astl
gggttaggaaggccg

SEQ ID NO: 78609 - DNA, 15 bp, Artificial Sequence
  dgRNA
  Astl
aggctagaacctgta

SEQ ID NO: 78610 - DNA, 15 bp, Artificial Sequence
  dgRNA
  Astl
tgtggggtctgatca

SEQ ID NO: 78611 - DNA, 15 bp, Artificial Sequence
  dgRNA
  Astl
atgtggggtctgatc

SEQ ID NO: 78612 - DNA, 15 bp, Artificial Sequence
  dgRNA
  Lhfp
tggcctcggcgcccc

SEQ ID NO: 78613 - DNA, 15 bp, Artificial Sequence
  dgRNA
  Lhfp
cactctcgcgcgtcc

SEQ ID NO: 78614 - DNA, 15 bp, Artificial Sequence
  dgRNA
  Lhfp
gcgtccaggactgcg

SEQ ID NO: 78615 - DNA, 15 bp, Artificial Sequence
  dgRNA
  Lhfp
caggactgcgcggcg

SEQ ID NO: 78616 - DNA, 15 bp, Artificial Sequence
  dgRNA
  Clec18a
gtaggccaatcagca

SEQ ID NO: 78617 - DNA, 15 bp, Artificial Sequence
  dgRNA
  Clec18a
ctacaatgattagca

SEQ ID NO: 78618 - DNA, 15 bp, Artificial Sequence
  dgRNA
  Clec18a
tacaatgattagcag

SEQ ID NO: 78619 - DNA, 15 bp, Artificial Sequence
  dgRNA
  Clec18a
attagcaggggccac

SEQ ID NO: 78620 - DNA, 15 bp, Artificial Sequence
  dgRNA
  9-Sep
gtaacagcgcctccg

SEQ ID NO: 78621 - DNA, 15 bp, Artificial Sequence
  dgRNA
  9-Sep
caagcctccctccgc

SEQ ID NO: 78622 - DNA, 15 bp, Artificial Sequence
  dgRNA
  9-Sep
ttacagtatggtcct

SEQ ID NO: 78623 - DNA, 15 bp, Artificial Sequence
  dgRNA
  9-Sep
acagggtatccgcgg

SEQ ID NO: 78624 - DNA, 15 bp, Artificial Sequence
  dgRNA
  Ssxb10
agacaaccctctact

SEQ ID NO: 78625 - DNA, 15 bp, Artificial Sequence
  dgRNA
  Gm10778
ggacgactttgcaat

SEQ ID NO: 78626 - DNA, 15 bp, Artificial Sequence
  dgRNA
  Gm10778
gacgactttgcaata

SEQ ID NO: 78627 - DNA, 15 bp, Artificial Sequence
  dgRNA
  Gm10778
agggtgcaggttcta

SEQ ID NO: 78628 - DNA, 15 bp, Artificial Sequence
  dgRNA
  Gm10778
ctatggtctgtgcct

SEQ ID NO: 78629 - DNA, 15 bp, Artificial Sequence
  dgRNA
  Uba5
gccgtcgacttgatc

SEQ ID NO: 78630 - DNA, 15 bp, Artificial Sequence
  dgRNA
  Uba5
taccgagcggagcga

SEQ ID NO: 78631 - DNA, 15 bp, Artificial Sequence
  dgRNA
  Uba5
cgagcggagcgatgg

SEQ ID NO: 78632 - DNA, 15 bp, Artificial Sequence
  dgRNA
  Uba5
gcggagcgatggcgg

SEQ ID NO: 78633 - DNA, 15 bp, Artificial Sequence
  dgRNA
  Mknk1
gctaaactcaggggg

SEQ ID NO: 78634 - DNA, 15 bp, Artificial Sequence
  dgRNA
  Mknk1
cggagctaaactcag

SEQ ID NO: 78635 - DNA, 15 bp, Artificial Sequence
  dgRNA
  Mknk1
gcggagctaaactca

SEQ ID NO: 78636 - DNA, 15 bp, Artificial Sequence
  dgRNA
  Mknk1
ggcggagctaaactc

SEQ ID NO: 78637 - DNA, 15 bp, Artificial Sequence
  dgRNA
  Lpcat3
cgacccactcctgcc

SEQ ID NO: 78638 - DNA, 15 bp, Artificial Sequence
  dgRNA
  Lpcat3
ctgcccggagccgtc

SEQ ID NO: 78639 - DNA, 15 bp, Artificial Sequence
  dgRNA
  Lpcat3
gctccaatagcagct

SEQ ID NO: 78640 - DNA, 15 bp, Artificial Sequence
  dgRNA
  Lpcat3
ggtcggacgggtgtc

SEQ ID NO: 78641 - DNA, 15 bp, Artificial Sequence
  dgRNA
  Nav2
ctgcgacatccgcgc

SEQ ID NO: 78642 - DNA, 15 bp, Artificial Sequence
  dgRNA
  Nav2
cgacatccgcgcagg

SEQ ID NO: 78643 - DNA, 15 bp, Artificial Sequence
  dgRNA
  Nav2
gacatccgcgcaggt

SEQ ID NO: 78644 - DNA, 15 bp, Artificial Sequence
  dgRNA
  Nav2
agcccgccacccggc

SEQ ID NO: 78645 - DNA, 15 bp, Artificial Sequence
  dgRNA
  Pwp2
tctccaccgtcctag

SEQ ID NO: 78646 - DNA, 15 bp, Artificial Sequence
  dgRNA
  Pwp2
gcagcgcctgcgtag

SEQ ID NO: 78647 - DNA, 15 bp, Artificial Sequence
  dgRNA
  Pwp2
cgcctgcgtagaggc

SEQ ID NO: 78648 - DNA, 15 bp, Artificial Sequence
  dgRNA
  Pwp2
gcctgcgtagaggca

SEQ ID NO: 78649 - DNA, 15 bp, Artificial Sequence
  dgRNA
  Pde1a
tggattgctcccgtg

SEQ ID NO: 78650 - DNA, 15 bp, Artificial Sequence
  dgRNA
  Pde1a
atactctgtctgctt

SEQ ID NO: 78651 - DNA, 15 bp, Artificial Sequence
  dgRNA
  Pde1a
tatgcctgtcaaaga

SEQ ID NO: 78652 - DNA, 15 bp, Artificial Sequence
  dgRNA
  Pde1a
caaagacggcagttc

SEQ ID NO: 78653 - DNA, 15 bp, Artificial Sequence
  dgRNA
  Ptar1
tgggacacggctgct

SEQ ID NO: 78654 - DNA, 15 bp, Artificial Sequence
  dgRNA
  Ptar1
tgctcggagaagtgc

SEQ ID NO: 78655 - DNA, 15 bp, Artificial Sequence
  dgRNA
  Ptar1
gctcggagaagtgcg

SEQ ID NO: 78656 - DNA, 15 bp, Artificial Sequence
  dgRNA
  Ptar1
ctcggagaagtgcgg

SEQ ID NO: 78657 - DNA, 15 bp, Artificial Sequence
  dgRNA
  Vapa
cccgaccctgctcta

SEQ ID NO: 78658 - DNA, 15 bp, Artificial Sequence
  dgRNA
  Vapa
tacggagattgacag

SEQ ID NO: 78659 - DNA, 15 bp, Artificial Sequence
  dgRNA
  Vapa
agattgacagcggcg

SEQ ID NO: 78660 - DNA, 15 bp, Artificial Sequence
  dgRNA
  Vapa
cagcggcgcggcgcc

SEQ ID NO: 78661 - DNA, 15 bp, Artificial Sequence
  dgRNA
  Ihh
gggcgggtggacgcg

SEQ ID NO: 78662 - DNA, 15 bp, Artificial Sequence
  dgRNA
  Ihh
gtggacgcgcggctg

SEQ ID NO: 78663 - DNA, 15 bp, Artificial Sequence
  dgRNA
  Ihh
cggctgaggagcgcg

SEQ ID NO: 78664 - DNA, 15 bp, Artificial Sequence
  dgRNA
  Ihh
ggctgaggagcgcgc

SEQ ID NO: 78665 - DNA, 15 bp, Artificial Sequence
  dgRNA
  Txndc16
acccacgctgctgat

SEQ ID NO: 78666 - DNA, 15 bp, Artificial Sequence
  dgRNA
  Txndc16
aagacttcctcgcgc

SEQ ID NO: 78667 - DNA, 15 bp, Artificial Sequence
  dgRNA
  Txndc16
acttcctcgcgccgg

SEQ ID NO: 78668 - DNA, 15 bp, Artificial Sequence
  dgRNA
  Txndc16
cttcctcgcgccggc

SEQ ID NO: 78669 - DNA, 15 bp, Artificial Sequence
  dgRNA
  Ankrd45
tcagaacctgagcgc

SEQ ID NO: 78670 - DNA, 15 bp, Artificial Sequence
  dgRNA
  Ankrd45
cagaacctgagcgct

SEQ ID NO: 78671 - DNA, 15 bp, Artificial Sequence
  dgRNA
  Ankrd45
gcgctgggtgaggcg

SEQ ID NO: 78672 - DNA, 15 bp, Artificial Sequence
  dgRNA
  Ankrd45
gctgcgccgtcgcca

SEQ ID NO: 78673 - DNA, 15 bp, Artificial Sequence
  dgRNA
  Olfr2
gaacgcttgaagatt

SEQ ID NO: 78674 - DNA, 15 bp, Artificial Sequence
  dgRNA
  Olfr12
aactatgtaaactag

SEQ ID NO: 78675 - DNA, 15 bp, Artificial Sequence
  dgRNA
  Olfr12
cttctccttatgaat

SEQ ID NO: 78676 - DNA, 15 bp, Artificial Sequence
  dgRNA
  Olfr12
gatctcctgccagat

SEQ ID NO: 78677 - DNA, 15 bp, Artificial Sequence
  dgRNA
  Slc7a7
cccccggctgcaagc

SEQ ID NO: 78678 - DNA, 15 bp, Artificial Sequence
  dgRNA
  Slc7a7
tcccccgctgcccct

SEQ ID NO: 78679 - DNA, 15 bp, Artificial Sequence
  dgRNA
  Slc7a7
tgggacttcccggcc

SEQ ID NO: 78680 - DNA, 15 bp, Artificial Sequence
  dgRNA
  Slc7a7
gggacttcccggcct

SEQ ID NO: 78681 - DNA, 15 bp, Artificial Sequence
  dgRNA
  Zbtb8b
tcaccccatgaacgc

SEQ ID NO: 78682 - DNA, 15 bp, Artificial Sequence
  dgRNA
  Zbtb8b
cgcatcctccagagg

SEQ ID NO: 78683 - DNA, 15 bp, Artificial Sequence
  dgRNA
  Zbtb8b
tacccggaccattga

SEQ ID NO: 78684 - DNA, 15 bp, Artificial Sequence
  dgRNA
  Zbtb8b
cattgacggacctgc

SEQ ID NO: 78685 - DNA, 15 bp, Artificial Sequence
  dgRNA
  Nsun7
ccgagcgctttcccc

SEQ ID NO: 78686 - DNA, 15 bp, Artificial Sequence
  dgRNA
  Nsun7
tcccccggccgaacc

SEQ ID NO: 78687 - DNA, 15 bp, Artificial Sequence
  dgRNA
  Nsun7
cccggccgaacccgg

SEQ ID NO: 78688 - DNA, 15 bp, Artificial Sequence
  dgRNA
  Nsun7
ccggccgaacccggt

SEQ ID NO: 78689 - DNA, 15 bp, Artificial Sequence
  dgRNA
  Abcc4
ccggtcacctgcgcg

SEQ ID NO: 78690 - DNA, 15 bp, Artificial Sequence
  dgRNA
  Abcc4
tcacctgcgcgcggt

SEQ ID NO: 78691 - DNA, 15 bp, Artificial Sequence
  dgRNA
  Abcc4
cgacacgcttctccc

SEQ ID NO: 78692 - DNA, 15 bp, Artificial Sequence
  dgRNA
  Abcc4
ctcccaggctcgagg

SEQ ID NO: 78693 - DNA, 15 bp, Artificial Sequence
  dgRNA
  Rxrb
tccgcccttcaggtt

SEQ ID NO: 78694 - DNA, 15 bp, Artificial Sequence
  dgRNA
  Rxrb
ccgcccttcaggttc

SEQ ID NO: 78695 - DNA, 15 bp, Artificial Sequence
  dgRNA
  Rxrb
tcaggttcgggcccg

SEQ ID NO: 78696 - DNA, 15 bp, Artificial Sequence
  dgRNA
  Rxrb
ggttcgggcccgcgg

SEQ ID NO: 78697 - DNA, 15 bp, Artificial Sequence
  dgRNA
  Olfr593
gtacctttaaatgta

SEQ ID NO: 78698 - DNA, 15 bp, Artificial Sequence
  dgRNA
  Olfr593
gaataccttttatgc

SEQ ID NO: 78699 - DNA, 15 bp, Artificial Sequence
  dgRNA
  Cep162
gcagctcgctgcgga

SEQ ID NO: 78700 - DNA, 15 bp, Artificial Sequence
  dgRNA
  Cep162
gaaggacgagcacaa

SEQ ID NO: 78701 - DNA, 15 bp, Artificial Sequence
  dgRNA
  Cep162
aaggacgagcacaaa

SEQ ID NO: 78702 - DNA, 15 bp, Artificial Sequence
  dgRNA
  Cep162
cagaaagccacgcgc

SEQ ID NO: 78703 - DNA, 15 bp, Artificial Sequence
  dgRNA
  Hbq1a
ttactacatgcacat

SEQ ID NO: 78704 - DNA, 15 bp, Artificial Sequence
  dgRNA
  Grm1
tattagacaaacctt

SEQ ID NO: 78705 - DNA, 15 bp, Artificial Sequence
  dgRNA
  Grm1
agtgtacagcccaga

SEQ ID NO: 78706 - DNA, 15 bp, Artificial Sequence
  dgRNA
  Grm1
ttgcaccgtctgatt

SEQ ID NO: 78707 - DNA, 15 bp, Artificial Sequence
  dgRNA
  Grm1
actattataccgcaa

SEQ ID NO: 78708 - DNA, 15 bp, Artificial Sequence
  dgRNA
  Pcdhb4
aacaagtgagcgaaa

SEQ ID NO: 78709 - DNA, 15 bp, Artificial Sequence
  dgRNA
  Pcdhb4
acaagtgagcgaaaa

SEQ ID NO: 78710 - DNA, 15 bp, Artificial Sequence
  dgRNA
  Pcdhb4
gtgaataaggacgct

SEQ ID NO: 78711 - DNA, 15 bp, Artificial Sequence
  dgRNA
  Pcdhb4
aataaggacgcttgg

SEQ ID NO: 78712 - DNA, 15 bp, Artificial Sequence
  dgRNA
  Ncoa4
cctcttgaccgccgc

SEQ ID NO: 78713 - DNA, 15 bp, Artificial Sequence
  dgRNA
  Ncoa4
ctcttgaccgccgct

SEQ ID NO: 78714 - DNA, 15 bp, Artificial Sequence
  dgRNA
  Ncoa4
gaccgccgctgggcc

SEQ ID NO: 78715 - DNA, 15 bp, Artificial Sequence
  dgRNA
  Ncoa4
accgccgctgggccc

SEQ ID NO: 78716 - DNA, 15 bp, Artificial Sequence
  dgRNA
  Srsf5
taagtgcgtcagttg

SEQ ID NO: 78717 - DNA, 15 bp, Artificial Sequence
  dgRNA
  Srsf5
agactgtagacgagt

SEQ ID NO: 78718 - DNA, 15 bp, Artificial Sequence
  dgRNA
  Srsf5
gactgtagacgagtt

SEQ ID NO: 78719 - DNA, 15 bp, Artificial Sequence
  dgRNA
  Srsf5
atggaagggacgtcc

SEQ ID NO: 78720 - DNA, 15 bp, Artificial Sequence
  dgRNA
  Med4
ctgtagtgcacctcc

SEQ ID NO: 78721 - DNA, 15 bp, Artificial Sequence
  dgRNA
  Med4
aggcggcgctctagc

SEQ ID NO: 78722 - DNA, 15 bp, Artificial Sequence
  dgRNA
  Med4
gttccgcccctcctg

SEQ ID NO: 78723 - DNA, 15 bp, Artificial Sequence
  dgRNA
  Med4
acactgcgcatgcga

SEQ ID NO: 78724 - DNA, 15 bp, Artificial Sequence
  dgRNA
  Bend7
ggacgctgaaccgcg

SEQ ID NO: 78725 - DNA, 15 bp, Artificial Sequence
  dgRNA
  Bend7
gaaccgcgcggcctc

SEQ ID NO: 78726 - DNA, 15 bp, Artificial Sequence
  dgRNA
  Bend7
gcctccggcccatgc

SEQ ID NO: 78727 - DNA, 15 bp, Artificial Sequence
  dgRNA
  Bend7
cctccggcccatgcc

SEQ ID NO: 78728 - DNA, 15 bp, Artificial Sequence
  dgRNA
  Krt2
ttcgcaaatcaaagc

SEQ ID NO: 78729 - DNA, 15 bp, Artificial Sequence
  dgRNA
  Krt2
aatcaaagcaggttc

SEQ ID NO: 78730 - DNA, 15 bp, Artificial Sequence
  dgRNA
  Krt2
aaacccatgcgtaag

SEQ ID NO: 78731 - DNA, 15 bp, Artificial Sequence
  dgRNA
  Krt2
aacccatgcgtaagt

SEQ ID NO: 78732 - DNA, 15 bp, Artificial Sequence
  dgRNA
  Mcemp1
ccagggcgagagatc

SEQ ID NO: 78733 - DNA, 15 bp, Artificial Sequence
  dgRNA
  Mcemp1
gcgagagatctggtg

SEQ ID NO: 78734 - DNA, 15 bp, Artificial Sequence
  dgRNA
  Mcemp1
ctgacatcttccggt

SEQ ID NO: 78735 - DNA, 15 bp, Artificial Sequence
  dgRNA
  Mcemp1
acatcttccggtagg

SEQ ID NO: 78736 - DNA, 15 bp, Artificial Sequence
  dgRNA
  Stat4
aaatttagaacggaa

SEQ ID NO: 78737 - DNA, 15 bp, Artificial Sequence
  dgRNA
  Stat4
aacggaaaggaaccg

SEQ ID NO: 78738 - DNA, 15 bp, Artificial Sequence
  dgRNA
  Stat4
ccctctttatgacat

SEQ ID NO: 78739 - DNA, 15 bp, Artificial Sequence
  dgRNA
  Mccc1
gtccaatcagccaat

SEQ ID NO: 78740 - DNA, 15 bp, Artificial Sequence
  dgRNA
  Mccc1
acccagttttgtgat

SEQ ID NO: 78741 - DNA, 15 bp, Artificial Sequence
  dgRNA
  Mccc1
ccatctggaggggcg

SEQ ID NO: 78742 - DNA, 15 bp, Artificial Sequence
  dgRNA
  Mccc1
ttggaccatgtgcct

SEQ ID NO: 78743 - DNA, 15 bp, Artificial Sequence
  dgRNA
  Prrc2b
gaggctcggctggag

SEQ ID NO: 78744 - DNA, 15 bp, Artificial Sequence
  dgRNA
  Kif22
gaagtgagcccgaga

SEQ ID NO: 78745 - DNA, 15 bp, Artificial Sequence
  dgRNA
  Kif22
gtgagcccgagacgg

SEQ ID NO: 78746 - DNA, 15 bp, Artificial Sequence
  dgRNA
  Kif22
gagacggcggaatta

SEQ ID NO: 78747 - DNA, 15 bp, Artificial Sequence
  dgRNA
  Kif22
tagaaccgaaacttc

SEQ ID NO: 78748 - DNA, 15 bp, Artificial Sequence
  dgRNA
  Shank1
agaatgggcgaggtt

SEQ ID NO: 78749 - DNA, 15 bp, Artificial Sequence
  dgRNA
  Shank1
gaatgggcgaggttt

SEQ ID NO: 78750 - DNA, 15 bp, Artificial Sequence
  dgRNA
  Shank1
atgggcgaggtttgg

SEQ ID NO: 78751 - DNA, 15 bp, Artificial Sequence
  dgRNA
  Shank1
ggcgatatctctctg

SEQ ID NO: 78752 - DNA, 15 bp, Artificial Sequence
  dgRNA
  Mrpl53
tgacctagatctcgc

SEQ ID NO: 78753 - DNA, 15 bp, Artificial Sequence
  dgRNA
  Mrpl53
ctagatctcgcaggc

SEQ ID NO: 78754 - DNA, 15 bp, Artificial Sequence
  dgRNA
  Mrpl53
ggaccccgagggaga

SEQ ID NO: 78755 - DNA, 15 bp, Artificial Sequence
  dgRNA
  Mrpl53
gacgttttcctgcga

SEQ ID NO: 78756 - DNA, 15 bp, Artificial Sequence
  dgRNA
  Nars2
ctgcaccgcccctac

SEQ ID NO: 78757 - DNA, 15 bp, Artificial Sequence
  dgRNA
  Nars2
ccgcccctaccggtg

SEQ ID NO: 78758 - DNA, 15 bp, Artificial Sequence
  dgRNA
  Nars2
cgcctcacgagctcc

SEQ ID NO: 78759 - DNA, 15 bp, Artificial Sequence
  dgRNA
  Nars2
gttgggtcatctcta

SEQ ID NO: 78760 - DNA, 15 bp, Artificial Sequence
  dgRNA
  Agpat9
aggaggtcgtgttgc

SEQ ID NO: 78761 - DNA, 15 bp, Artificial Sequence
  dgRNA
  Agpat9
atcttccgcagcgat

SEQ ID NO: 78762 - DNA, 15 bp, Artificial Sequence
  dgRNA
  Agpat9
tcttccgcagcgatc

SEQ ID NO: 78763 - DNA, 15 bp, Artificial Sequence
  dgRNA
  Agpat9
cttccgcagcgatcg

SEQ ID NO: 78764 - DNA, 15 bp, Artificial Sequence
  dgRNA
  Crybg3
tcaaaaacgtgctga

SEQ ID NO: 78765 - DNA, 15 bp, Artificial Sequence
  dgRNA
  Crybg3
aaaaacgtgctgaag

SEQ ID NO: 78766 - DNA, 15 bp, Artificial Sequence
  dgRNA
  Crybg3
gatgttggcaaggcg

SEQ ID NO: 78767 - DNA, 15 bp, Artificial Sequence
  dgRNA
  Crybg3
tttctaccaaagcga

SEQ ID NO: 78768 - DNA, 15 bp, Artificial Sequence
  dgRNA
  Hoxd8
tgattcgctttgata

SEQ ID NO: 78769 - DNA, 15 bp, Artificial Sequence
  dgRNA
  Hoxd8
cgctttgataaggtc

SEQ ID NO: 78770 - DNA, 15 bp, Artificial Sequence
  dgRNA
  Hoxd8
aaggtcaggattcgg

SEQ ID NO: 78771 - DNA, 15 bp, Artificial Sequence
  dgRNA
  Hoxd8
gcccaaacaaatgca

SEQ ID NO: 78772 - DNA, 15 bp, Artificial Sequence
  dgRNA
  Cacnb2
ggtaactaactgtga

SEQ ID NO: 78773 - DNA, 15 bp, Artificial Sequence
  dgRNA
  Cacnb2
gtaactaactgtgat

SEQ ID NO: 78774 - DNA, 15 bp, Artificial Sequence
  dgRNA
  Cacnb2
ttgaattacgtcagc

SEQ ID NO: 78775 - DNA, 15 bp, Artificial Sequence
  dgRNA
  Cacnb2
taccaagggccaagt

SEQ ID NO: 78776 - DNA, 15 bp, Artificial Sequence
  dgRNA
  Cebpz
aggagccgcgccata

SEQ ID NO: 78777 - DNA, 15 bp, Artificial Sequence
  dgRNA
  Cebpz
gccatacggtttcca

SEQ ID NO: 78778 - DNA, 15 bp, Artificial Sequence
  dgRNA
  Cebpz
gactctcacccgcgc

SEQ ID NO: 78779 - DNA, 15 bp, Artificial Sequence
  dgRNA
  Cebpz
cattcctacaccccg

SEQ ID NO: 78780 - DNA, 15 bp, Artificial Sequence
  dgRNA
  Tmem134
ggctgtcgctcacca

SEQ ID NO: 78781 - DNA, 15 bp, Artificial Sequence
  dgRNA
  Tmem134
caccaagggaacctc

SEQ ID NO: 78782 - DNA, 15 bp, Artificial Sequence
  dgRNA
  Tmem134
accaagggaacctct

SEQ ID NO: 78783 - DNA, 15 bp, Artificial Sequence
  dgRNA
  Tmem134
gagcgggcaagggcg

SEQ ID NO: 78784 - DNA, 15 bp, Artificial Sequence
  dgRNA
  Fmr1
aagtgcgcgcgccaa

SEQ ID NO: 78785 - DNA, 15 bp, Artificial Sequence
  dgRNA
  Fmr1
agtgcgcgcgccaaa

SEQ ID NO: 78786 - DNA, 15 bp, Artificial Sequence
  dgRNA
  Fmr1
cgccctgataccctg

SEQ ID NO: 78787 - DNA, 15 bp, Artificial Sequence
  dgRNA
  Fmr1
gctccactgcccgag

SEQ ID NO: 78788 - DNA, 15 bp, Artificial Sequence
  dgRNA
  Snapc1
gtatcacaccaagtt

SEQ ID NO: 78789 - DNA, 15 bp, Artificial Sequence
  dgRNA
  Snapc1
cgcaagaagcgccac

SEQ ID NO: 78790 - DNA, 15 bp, Artificial Sequence
  dgRNA
  Snapc1
agcgccacaggcgcc

SEQ ID NO: 78791 - DNA, 15 bp, Artificial Sequence
  dgRNA
  Snapc1
gcgccaggtaagacc

SEQ ID NO: 78792 - DNA, 15 bp, Artificial Sequence
  dgRNA
  Gja4
gctgcggacctaggg

SEQ ID NO: 78793 - DNA, 15 bp, Artificial Sequence
  dgRNA
  Gja4
ctgcggacctaggga

SEQ ID NO: 78794 - DNA, 15 bp, Artificial Sequence
  dgRNA
  Gja4
agtctgggataccgg

SEQ ID NO: 78795 - DNA, 15 bp, Artificial Sequence
  dgRNA
  Gja4
gaagcacaatctggg

SEQ ID NO: 78796 - DNA, 15 bp, Artificial Sequence
  dgRNA
  Lcn3
attcgtcttgccagc

SEQ ID NO: 78797 - DNA, 15 bp, Artificial Sequence
  dgRNA
  Lcn3
tggacataactcaga

SEQ ID NO: 78798 - DNA, 15 bp, Artificial Sequence
  dgRNA
  Lcn3
agagtagtcaagtga

SEQ ID NO: 78799 - DNA, 15 bp, Artificial Sequence
  dgRNA
  Lcn3
caggagaggctatac

SEQ ID NO: 78800 - DNA, 15 bp, Artificial Sequence
  dgRNA
  Fam65b
gagaccagccggaca

SEQ ID NO: 78801 - DNA, 15 bp, Artificial Sequence
  dgRNA
  Tm2d2
gctccagttcgcgcc

SEQ ID NO: 78802 - DNA, 15 bp, Artificial Sequence
  dgRNA
  Tm2d2
cctccgcccgctcag

SEQ ID NO: 78803 - DNA, 15 bp, Artificial Sequence
  dgRNA
  Tm2d2
ccgtgcagcagtgaa

SEQ ID NO: 78804 - DNA, 15 bp, Artificial Sequence
  dgRNA
  Tm2d2
tgaagggtctactgg

SEQ ID NO: 78805 - DNA, 15 bp, Artificial Sequence
  dgRNA
  Tbca
aagagtcgggaggcg

SEQ ID NO: 78806 - DNA, 15 bp, Artificial Sequence
  dgRNA
  Tbca
agtcgggaggcgagg

SEQ ID NO: 78807 - DNA, 15 bp, Artificial Sequence
  dgRNA
  Tbca
aggcgaggcggggtc

SEQ ID NO: 78808 - DNA, 15 bp, Artificial Sequence
  dgRNA
  Tbca
ggggtcgggctctcc

SEQ ID NO: 78809 - DNA, 15 bp, Artificial Sequence
  dgRNA
  Pou5f2
ttgaaaacaacggtc

SEQ ID NO: 78810 - DNA, 15 bp, Artificial Sequence
  dgRNA
  Pou5f2
aacaacggtcaggac

SEQ ID NO: 78811 - DNA, 15 bp, Artificial Sequence
  dgRNA
  Pou5f2
aacggtcaggacagg

SEQ ID NO: 78812 - DNA, 15 bp, Artificial Sequence
  dgRNA
  Pou5f2
gtgttttcaaacccg

SEQ ID NO: 78813 - DNA, 15 bp, Artificial Sequence
  dgRNA
  Syt5
tccctcccgttgcct

SEQ ID NO: 78814 - DNA, 15 bp, Artificial Sequence
  dgRNA
  Syt5
tgctatcaccctgcc

SEQ ID NO: 78815 - DNA, 15 bp, Artificial Sequence
  dgRNA
  Syt5
gcctggcggtcgctc

SEQ ID NO: 78816 - DNA, 15 bp, Artificial Sequence
  dgRNA
  Syt5
cctggcggtcgctca

SEQ ID NO: 78817 - DNA, 15 bp, Artificial Sequence
  dgRNA
  Arhgef16
caaacaggttcccgc

SEQ ID NO: 78818 - DNA, 15 bp, Artificial Sequence
  dgRNA
  Arhgef16
ggttcccgcaggccc

SEQ ID NO: 78819 - DNA, 15 bp, Artificial Sequence
  dgRNA
  Arhgef16
ccgggatttctccga

SEQ ID NO: 78820 - DNA, 15 bp, Artificial Sequence
  dgRNA
  Arhgef16
tctccgaaggcttcc

SEQ ID NO: 78821 - DNA, 15 bp, Artificial Sequence
  dgRNA
  Ndufv1
tcgtgcatatatagc

SEQ ID NO: 78822 - DNA, 15 bp, Artificial Sequence
  dgRNA
  Ndufv1
agacgcaaagtctgt

SEQ ID NO: 78823 - DNA, 15 bp, Artificial Sequence
  dgRNA
  Ndufv1
ggcgacacgtgagcc

SEQ ID NO: 78824 - DNA, 15 bp, Artificial Sequence
  dgRNA
  Ndufv1
aagagtctccgagaa

SEQ ID NO: 78825 - DNA, 15 bp, Artificial Sequence
  dgRNA
  Fermt3
caaccagtagatgcc

SEQ ID NO: 78826 - DNA, 15 bp, Artificial Sequence
  dgRNA
  Fermt3
aaccagtagatgcct

SEQ ID NO: 78827 - DNA, 15 bp, Artificial Sequence
  dgRNA
  Fermt3
ccagtagatgcctgg

SEQ ID NO: 78828 - DNA, 15 bp, Artificial Sequence
  dgRNA
  Fermt3
cccccaggcatctac

SEQ ID NO: 78829 - DNA, 15 bp, Artificial Sequence
  dgRNA
  Irf9
agatgtgaaacaccg

SEQ ID NO: 78830 - DNA, 15 bp, Artificial Sequence
  dgRNA
  Irf9
tgtgaaacaccgcgg

SEQ ID NO: 78831 - DNA, 15 bp, Artificial Sequence
  dgRNA
  Irf9
tctagccacctggct

SEQ ID NO: 78832 - DNA, 15 bp, Artificial Sequence
  dgRNA
  Irf9
caagcagacacggtt

SEQ ID NO: 78833 - DNA, 15 bp, Artificial Sequence
  dgRNA
  Cdhr3
gacaagctagcctat

SEQ ID NO: 78834 - DNA, 15 bp, Artificial Sequence
  dgRNA
  Cdhr3
acaagctagcctatt

SEQ ID NO: 78835 - DNA, 15 bp, Artificial Sequence
  dgRNA
  Cdhr3
ggttatcacacgtgt

SEQ ID NO: 78836 - DNA, 15 bp, Artificial Sequence
  dgRNA
  Cdhr3
acgtgttggtcatca

SEQ ID NO: 78837 - DNA, 15 bp, Artificial Sequence
  dgRNA
  Nop14
tcggggcggcgtctg

SEQ ID NO: 78838 - DNA, 15 bp, Artificial Sequence
  dgRNA
  Nop14
cgtctgaggatactg

SEQ ID NO: 78839 - DNA, 15 bp, Artificial Sequence
  dgRNA
  Nop14
tactgtggcggctct

SEQ ID NO: 78840 - DNA, 15 bp, Artificial Sequence
  dgRNA
  Nop14
actgtggcggctctc

SEQ ID NO: 78841 - DNA, 15 bp, Artificial Sequence
  dgRNA
  Fads6
ttctaggccccgcct

SEQ ID NO: 78842 - DNA, 15 bp, Artificial Sequence
  dgRNA
  Fads6
gccccgcctaggtca

SEQ ID NO: 78843 - DNA, 15 bp, Artificial Sequence
  dgRNA
  Fads6
ccccgcctaggtcac

SEQ ID NO: 78844 - DNA, 15 bp, Artificial Sequence
  dgRNA
  Fads6
ctaggtcacgggtca

SEQ ID NO: 78845 - DNA, 15 bp, Artificial Sequence
  dgRNA
  Zdhhc20
gggcggacccggtcc

SEQ ID NO: 78846 - DNA, 15 bp, Artificial Sequence
  dgRNA
  Zdhhc20
acccggtccaggcgc

SEQ ID NO: 78847 - DNA, 15 bp, Artificial Sequence
  dgRNA
  Zdhhc20
cccggtccaggcgcc

SEQ ID NO: 78848 - DNA, 15 bp, Artificial Sequence
  dgRNA
  Zdhhc20
ggtccaggcgccggg

SEQ ID NO: 78849 - DNA, 15 bp, Artificial Sequence
  dgRNA
  Mc1r
ccaaagctagttttc

SEQ ID NO: 78850 - DNA, 15 bp, Artificial Sequence
  dgRNA
  Mc1r
agttttccggtttct

SEQ ID NO: 78851 - DNA, 15 bp, Artificial Sequence
  dgRNA
  Mc1r
ggcactacacatccc

SEQ ID NO: 78852 - DNA, 15 bp, Artificial Sequence
  dgRNA
  Mc1r
gtggccaccctcagg

SEQ ID NO: 78853 - DNA, 15 bp, Artificial Sequence
  dgRNA
  Qsox1
tcgttgagggggccg

SEQ ID NO: 78854 - DNA, 15 bp, Artificial Sequence
  dgRNA
  Qsox1
gtcgttgagggggcc

SEQ ID NO: 78855 - DNA, 15 bp, Artificial Sequence
  dgRNA
  Qsox1
ggtcgttgagggggc

SEQ ID NO: 78856 - DNA, 15 bp, Artificial Sequence
  dgRNA
  Ccdc183
actaccactgtcaag

SEQ ID NO: 78857 - DNA, 15 bp, Artificial Sequence
  dgRNA
  Ccdc183
ctaccactgtcaaga

SEQ ID NO: 78858 - DNA, 15 bp, Artificial Sequence
  dgRNA
  Ccdc183
gagccctcttgacag

SEQ ID NO: 78859 - DNA, 15 bp, Artificial Sequence
  dgRNA
  Ccdc183
gggttcttgtgctaa

SEQ ID NO: 78860 - DNA, 15 bp, Artificial Sequence
  dgRNA
  4930523C07Rik
tgttctgtgacaccg

SEQ ID NO: 78861 - DNA, 15 bp, Artificial Sequence
  dgRNA
  4930523C07Rik
taattgacgatcctc

SEQ ID NO: 78862 - DNA, 15 bp, Artificial Sequence
  dgRNA
  4930523C07Rik
tttgggcatgccacc

SEQ ID NO: 78863 - DNA, 15 bp, Artificial Sequence
  dgRNA
  4930523C07Rik
ctcagcttcacgttt

SEQ ID NO: 78864 - DNA, 15 bp, Artificial Sequence
  dgRNA
  Hist1h2bk
gttcaacttaaccaa

SEQ ID NO: 78865 - DNA, 15 bp, Artificial Sequence
  dgRNA
  Hist1h2bk
taaccaatggaaacg

SEQ ID NO: 78866 - DNA, 15 bp, Artificial Sequence
  dgRNA
  Hist1h2bk
atggaaacgaggttt

SEQ ID NO: 78867 - DNA, 15 bp, Artificial Sequence
  dgRNA
  Hist1h2bk
tggaaacgaggtttt

SEQ ID NO: 78868 - DNA, 15 bp, Artificial Sequence
  dgRNA
  Olfr622
atagaatattaccct

SEQ ID NO: 78869 - DNA, 15 bp, Artificial Sequence
  dgRNA
  Arhgef10
ctcctactcacggcg

SEQ ID NO: 78870 - DNA, 15 bp, Artificial Sequence
  dgRNA
  Arhgef10
tcctactcacggcgc

SEQ ID NO: 78871 - DNA, 15 bp, Artificial Sequence
  dgRNA
  Arhgef10
cctactcacggcgcg

SEQ ID NO: 78872 - DNA, 15 bp, Artificial Sequence
  dgRNA
  Arhgef10
acggcgcggggcgtt

SEQ ID NO: 78873 - DNA, 15 bp, Artificial Sequence
  dgRNA
  Gars
aagttggtgcccttc

SEQ ID NO: 78874 - DNA, 15 bp, Artificial Sequence
  dgRNA
  Gars
tctctgccgaatctg

SEQ ID NO: 78875 - DNA, 15 bp, Artificial Sequence
  dgRNA
  Gars
ctgcggttgcagacg

SEQ ID NO: 78876 - DNA, 15 bp, Artificial Sequence
  dgRNA
  Gars
cggttgcagacgcgg

SEQ ID NO: 78877 - DNA, 15 bp, Artificial Sequence
  dgRNA
  Setd8
gagaagggcggacac

SEQ ID NO: 78878 - DNA, 15 bp, Artificial Sequence
  dgRNA
  Setd8
cagcccgcgaaagag

SEQ ID NO: 78879 - DNA, 15 bp, Artificial Sequence
  dgRNA
  Setd8
ccgcgaaagagcggg

SEQ ID NO: 78880 - DNA, 15 bp, Artificial Sequence
  dgRNA
  Setd8
tgattggcgggctcg

SEQ ID NO: 78881 - DNA, 15 bp, Artificial Sequence
  dgRNA
  Epb41l2
gctgtcattatctcc

SEQ ID NO: 78882 - DNA, 15 bp, Artificial Sequence
  dgRNA
  Epb41l2
tccagggtcgctccg

SEQ ID NO: 78883 - DNA, 15 bp, Artificial Sequence
  dgRNA
  Epb41l2
ccagggtcgctccga

SEQ ID NO: 78884 - DNA, 15 bp, Artificial Sequence
  dgRNA
  Epb41l2
cgaaacgcacccctg

SEQ ID NO: 78885 - DNA, 15 bp, Artificial Sequence
  dgRNA
  Adgre4
ctttacactagtaaa

SEQ ID NO: 78886 - DNA, 15 bp, Artificial Sequence
  dgRNA
  Adgre4
gaactaattagagtt

SEQ ID NO: 78887 - DNA, 15 bp, Artificial Sequence
  dgRNA
  Adgre4
ggtctacaaatagca

SEQ ID NO: 78888 - DNA, 15 bp, Artificial Sequence
  dgRNA
  Adgre4
gatcatgcagtgcct

SEQ ID NO: 78889 - DNA, 15 bp, Artificial Sequence
  dgRNA
  Mettl1
gccagaacgacccaa

SEQ ID NO: 78890 - DNA, 15 bp, Artificial Sequence
  dgRNA
  Mettl1
ccaagggaggatgcg

SEQ ID NO: 78891 - DNA, 15 bp, Artificial Sequence
  dgRNA
  Mettl1
cggggtgcccggagc

SEQ ID NO: 78892 - DNA, 15 bp, Artificial Sequence
  dgRNA
  Mettl1
acggttagcaatagc

SEQ ID NO: 78893 - DNA, 15 bp, Artificial Sequence
  dgRNA
  Ntan1
gacacgggtagtgag

SEQ ID NO: 78894 - DNA, 15 bp, Artificial Sequence
  dgRNA
  Ntan1
gacgccgacaaagtt

SEQ ID NO: 78895 - DNA, 15 bp, Artificial Sequence
  dgRNA
  Ntan1
atgccttgcagccca

SEQ ID NO: 78896 - DNA, 15 bp, Artificial Sequence
  dgRNA
  Ntan1
tgccttgcagcccaa

SEQ ID NO: 78897 - DNA, 15 bp, Artificial Sequence
  dgRNA
  Alx3
cgactgctagacaaa

SEQ ID NO: 78898 - DNA, 15 bp, Artificial Sequence
  dgRNA
  Alx3
gactgctagacaaaa

SEQ ID NO: 78899 - DNA, 15 bp, Artificial Sequence
  dgRNA
  Alx3
gatcctgccctcgaa

SEQ ID NO: 78900 - DNA, 15 bp, Artificial Sequence
  dgRNA
  Alx3
ttgtgataccagact

SEQ ID NO: 78901 - DNA, 15 bp, Artificial Sequence
  dgRNA
  Maff
cagcacggagaaccg

SEQ ID NO: 78902 - DNA, 15 bp, Artificial Sequence
  dgRNA
  Maff
cacggagaaccgtgg

SEQ ID NO: 78903 - DNA, 15 bp, Artificial Sequence
  dgRNA
  Maff
gaaccgtggcggctc

SEQ ID NO: 78904 - DNA, 15 bp, Artificial Sequence
  dgRNA
  Maff
ggcggctctggctgt

SEQ ID NO: 78905 - DNA, 15 bp, Artificial Sequence
  dgRNA
  Lgr5
cgggacgctgggtgc

SEQ ID NO: 78906 - DNA, 15 bp, Artificial Sequence
  dgRNA
  Lgr5
caggtacccacccat

SEQ ID NO: 78907 - DNA, 15 bp, Artificial Sequence
  dgRNA
  Lgr5
agccgcccgcgcagc

SEQ ID NO: 78908 - DNA, 15 bp, Artificial Sequence
  dgRNA
  Lgr5
gccgcccgcgcagcc

SEQ ID NO: 78909 - DNA, 15 bp, Artificial Sequence
  dgRNA
  Lias
ctagtcgagtcgcgc

SEQ ID NO: 78910 - DNA, 15 bp, Artificial Sequence
  dgRNA
  Lias
tcgagtcgcgccggt

SEQ ID NO: 78911 - DNA, 15 bp, Artificial Sequence
  dgRNA
  Lias
gcgactcgactagct

SEQ ID NO: 78912 - DNA, 15 bp, Artificial Sequence
  dgRNA
  Lias
tacgtcgtcgccgac

SEQ ID NO: 78913 - DNA, 15 bp, Artificial Sequence
  dgRNA
  U2af2
gcttggggcttgatt

SEQ ID NO: 78914 - DNA, 15 bp, Artificial Sequence
  dgRNA
  U2af2
ggggcttgattaggt

SEQ ID NO: 78915 - DNA, 15 bp, Artificial Sequence
  dgRNA
  U2af2
tgattaggtaggcga

SEQ ID NO: 78916 - DNA, 15 bp, Artificial Sequence
  dgRNA
  U2af2
taggcgacggagtgc

SEQ ID NO: 78917 - DNA, 15 bp, Artificial Sequence
  dgRNA
  Srpk1
aagccgcgcgcttta

SEQ ID NO: 78918 - DNA, 15 bp, Artificial Sequence
  dgRNA
  Srpk1
ccgcgcgctttatgg

SEQ ID NO: 78919 - DNA, 15 bp, Artificial Sequence
  dgRNA
  Srpk1
cgcgcgctttatggc

SEQ ID NO: 78920 - DNA, 15 bp, Artificial Sequence
  dgRNA
  Srpk1
cactctcgtacaccc

SEQ ID NO: 78921 - DNA, 15 bp, Artificial Sequence
  dgRNA
  Mrpl37
aagtttcttcacgtg

SEQ ID NO: 78922 - DNA, 15 bp, Artificial Sequence
  dgRNA
  Mrpl37
actgcctgaggggcg

SEQ ID NO: 78923 - DNA, 15 bp, Artificial Sequence
  dgRNA
  Mrpl37
attctaattgtgatt

SEQ ID NO: 78924 - DNA, 15 bp, Artificial Sequence
  dgRNA
  Mrpl37
agctcgcggccggcg

SEQ ID NO: 78925 - DNA, 15 bp, Artificial Sequence
  dgRNA
  Otx2
gaaaattaatcagcc

SEQ ID NO: 78926 - DNA, 15 bp, Artificial Sequence
  dgRNA
  Otx2
gacggcctgtaatta

SEQ ID NO: 78927 - DNA, 15 bp, Artificial Sequence
  dgRNA
  Otx2
acggcctgtaattaa

SEQ ID NO: 78928 - DNA, 15 bp, Artificial Sequence
  dgRNA
  Otx2
gggacgtgtgcccct

SEQ ID NO: 78929 - DNA, 15 bp, Artificial Sequence
  dgRNA
  Vav3
cttgcatcgcaggat

SEQ ID NO: 78930 - DNA, 15 bp, Artificial Sequence
  dgRNA
  Vav3
acctacagtcattta

SEQ ID NO: 78931 - DNA, 15 bp, Artificial Sequence
  dgRNA
  Vav3
cctacagtcatttag

SEQ ID NO: 78932 - DNA, 15 bp, Artificial Sequence
  dgRNA
  Vav3
caatcctgcgatgca

SEQ ID NO: 78933 - DNA, 15 bp, Artificial Sequence
  dgRNA
  Arhgap29
caaggcccctctaag

SEQ ID NO: 78934 - DNA, 15 bp, Artificial Sequence
  dgRNA
  Arhgap29
cacccgcacctgtta

SEQ ID NO: 78935 - DNA, 15 bp, Artificial Sequence
  dgRNA
  Arhgap29
gacccgccccttcag

SEQ ID NO: 78936 - DNA, 15 bp, Artificial Sequence
  dgRNA
  Arhgap29
gtgaccccgcctcct

SEQ ID NO: 78937 - DNA, 15 bp, Artificial Sequence
  dgRNA
  Slc40a1
ccccgtcctactgtg

SEQ ID NO: 78938 - DNA, 15 bp, Artificial Sequence
  dgRNA
  Slc40a1
cccgtcctactgtgc

SEQ ID NO: 78939 - DNA, 15 bp, Artificial Sequence
  dgRNA
  Slc40a1
gtgcgggtcacccct

SEQ ID NO: 78940 - DNA, 15 bp, Artificial Sequence
  dgRNA
  Slc40a1
gttgtttgcgcctcc

SEQ ID NO: 78941 - DNA, 15 bp, Artificial Sequence
  dgRNA
  Mthfd1
ctgtcgccgcaacct

SEQ ID NO: 78942 - DNA, 15 bp, Artificial Sequence
  dgRNA
  Mthfd1
cacactatctctgat

SEQ ID NO: 78943 - DNA, 15 bp, Artificial Sequence
  dgRNA
  Mthfd1
gattggctaaaagcg

SEQ ID NO: 78944 - DNA, 15 bp, Artificial Sequence
  dgRNA
  Mthfd1
tggctaaaagcgagg

SEQ ID NO: 78945 - DNA, 15 bp, Artificial Sequence
  dgRNA
  Gcm1
tagtgtaccctgacc

SEQ ID NO: 78946 - DNA, 15 bp, Artificial Sequence
  dgRNA
  Gcm1
ccctgacctgggtta

SEQ ID NO: 78947 - DNA, 15 bp, Artificial Sequence
  dgRNA
  Gcm1
gtgatgaatattcta

SEQ ID NO: 78948 - DNA, 15 bp, Artificial Sequence
  dgRNA
  Gcm1
ccctaacccaggtca

SEQ ID NO: 78949 - DNA, 15 bp, Artificial Sequence
  dgRNA
  Txnrd1
agcgaggatgttgta

SEQ ID NO: 78950 - DNA, 15 bp, Artificial Sequence
  dgRNA
  Txnrd1
ttgtacggtccaatt

SEQ ID NO: 78951 - DNA, 15 bp, Artificial Sequence
  dgRNA
  Txnrd1
ctttgcggggacaac

SEQ ID NO: 78952 - DNA, 15 bp, Artificial Sequence
  dgRNA
  Txnrd1
tttgcggggacaacc

SEQ ID NO: 78953 - DNA, 15 bp, Artificial Sequence
  dgRNA
  Adam23
gcgcgcaggagcgag

SEQ ID NO: 78954 - DNA, 15 bp, Artificial Sequence
  dgRNA
  Zbed3
aaacgtgcagagcca

SEQ ID NO: 78955 - DNA, 15 bp, Artificial Sequence
  dgRNA
  Zbed3
aaactcctcccggac

SEQ ID NO: 78956 - DNA, 15 bp, Artificial Sequence
  dgRNA
  Zbed3
tcctcccggaccgga

SEQ ID NO: 78957 - DNA, 15 bp, Artificial Sequence
  dgRNA
  Zbed3
cggatggtttagcag

SEQ ID NO: 78958 - DNA, 15 bp, Artificial Sequence
  dgRNA
  Pcdha9
agttcgctgtttctc

SEQ ID NO: 78959 - DNA, 15 bp, Artificial Sequence
  dgRNA
  Pcdha9
gttcgctgtttctca

SEQ ID NO: 78960 - DNA, 15 bp, Artificial Sequence
  dgRNA
  Pcdha9
ttcgctgtttctcag

SEQ ID NO: 78961 - DNA, 15 bp, Artificial Sequence
  dgRNA
  Pcdha9
ggaagtagctacgtt

SEQ ID NO: 78962 - DNA, 15 bp, Artificial Sequence
  dgRNA
  Ifit2
taaagctaaaagcgg

SEQ ID NO: 78963 - DNA, 15 bp, Artificial Sequence
  dgRNA
  Ifit2
taaaagcggcggaga

SEQ ID NO: 78964 - DNA, 15 bp, Artificial Sequence
  dgRNA
  Ifit2
aaaagcggcggagaa

SEQ ID NO: 78965 - DNA, 15 bp, Artificial Sequence
  dgRNA
  Ifit2
tctggcgacaatagc

SEQ ID NO: 78966 - DNA, 15 bp, Artificial Sequence
  dgRNA
  Zmynd12
gtttttgacctatac

SEQ ID NO: 78967 - DNA, 15 bp, Artificial Sequence
  dgRNA
  Zmynd12
cgtatagttctcccc

SEQ ID NO: 78968 - DNA, 15 bp, Artificial Sequence
  dgRNA
  Zmynd12
caggctcgggctaca

SEQ ID NO: 78969 - DNA, 15 bp, Artificial Sequence
  dgRNA
  Zmynd12
gaaatcccgacgtcc

SEQ ID NO: 78970 - DNA, 15 bp, Artificial Sequence
  dgRNA
  Slc25a47
ggcagacttaggtct

SEQ ID NO: 78971 - DNA, 15 bp, Artificial Sequence
  dgRNA
  Slc25a47
gctttcccgatgctc

SEQ ID NO: 78972 - DNA, 15 bp, Artificial Sequence
  dgRNA
  Slc25a47
cgatgctcgggtcat

SEQ ID NO: 78973 - DNA, 15 bp, Artificial Sequence
  dgRNA
  Slc25a47
gcaccccgaaccttg

SEQ ID NO: 78974 - DNA, 15 bp, Artificial Sequence
  dgRNA
  Lrrc29
acaagggcgagtaac

SEQ ID NO: 78975 - DNA, 15 bp, Artificial Sequence
  dgRNA
  Lrrc29
cagtagacaccacat

SEQ ID NO: 78976 - DNA, 15 bp, Artificial Sequence
  dgRNA
  Lrrc29
gcaatcgttcgctcc

SEQ ID NO: 78977 - DNA, 15 bp, Artificial Sequence
  dgRNA
  Lrrc29
caatcgttcgctcct

SEQ ID NO: 78978 - DNA, 15 bp, Artificial Sequence
  dgRNA
  Gm21319
attcaagctccgccc

SEQ ID NO: 78979 - DNA, 15 bp, Artificial Sequence
  dgRNA
  Gm21319
cactttaatccaaca

SEQ ID NO: 78980 - DNA, 15 bp, Artificial Sequence
  dgRNA
  Pknox2
cgtcccgagcagtgc

SEQ ID NO: 78981 - DNA, 15 bp, Artificial Sequence
  dgRNA
  Pknox2
gtcccgagcagtgct

SEQ ID NO: 78982 - DNA, 15 bp, Artificial Sequence
  dgRNA
  Pknox2
gacgtcagcggcaca

SEQ ID NO: 78983 - DNA, 15 bp, Artificial Sequence
  dgRNA
  Pknox2
ggacgtcagcggcac

SEQ ID NO: 78984 - DNA, 15 bp, Artificial Sequence
  dgRNA
  Nat9
gtccaagcgagcgcg

SEQ ID NO: 78985 - DNA, 15 bp, Artificial Sequence
  dgRNA
  Nat9
tccaagcgagcgcgt

SEQ ID NO: 78986 - DNA, 15 bp, Artificial Sequence
  dgRNA
  Nat9
ccaagcgagcgcgtg

SEQ ID NO: 78987 - DNA, 15 bp, Artificial Sequence
  dgRNA
  Nat9
agcgagcgcgtgggg

SEQ ID NO: 78988 - DNA, 15 bp, Artificial Sequence
  dgRNA
  Nusap1
aaggccagggcgccg

SEQ ID NO: 78989 - DNA, 15 bp, Artificial Sequence
  dgRNA
  Nusap1
aggccagggcgccga

SEQ ID NO: 78990 - DNA, 15 bp, Artificial Sequence
  dgRNA
  Nusap1
ccgagggaccgcgac

SEQ ID NO: 78991 - DNA, 15 bp, Artificial Sequence
  dgRNA
  Nusap1
accgcgacaggtccc

SEQ ID NO: 78992 - DNA, 15 bp, Artificial Sequence
  dgRNA
  Vprbp
gaagtcaatgcgctg

SEQ ID NO: 78993 - DNA, 15 bp, Artificial Sequence
  dgRNA
  Vprbp
gtcaatgcgctgagg

SEQ ID NO: 78994 - DNA, 15 bp, Artificial Sequence
  dgRNA
  Vprbp
ccccgcccttaaacg

SEQ ID NO: 78995 - DNA, 15 bp, Artificial Sequence
  dgRNA
  Vprbp
cgctttgatgtccct

SEQ ID NO: 78996 - DNA, 15 bp, Artificial Sequence
  dgRNA
  Ces5a
caggaaagtcccgtt

SEQ ID NO: 78997 - DNA, 15 bp, Artificial Sequence
  dgRNA
  Ces5a
atttacatacggagt

SEQ ID NO: 78998 - DNA, 15 bp, Artificial Sequence
  dgRNA
  Ces5a
gagaattgaccaaac

SEQ ID NO: 78999 - DNA, 15 bp, Artificial Sequence
  dgRNA
  Ces5a
tcaaaaatagcgtca

SEQ ID NO: 79000 - DNA, 15 bp, Artificial Sequence
  dgRNA
  Gps1
gtttaacttgcaggt

SEQ ID NO: 79001 - DNA, 15 bp, Artificial Sequence
  dgRNA
  Gps1
tttaacttgcaggta

SEQ ID NO: 79002 - DNA, 15 bp, Artificial Sequence
  dgRNA
  Gps1
gctgcgctcgccgcg

SEQ ID NO: 79003 - DNA, 15 bp, Artificial Sequence
  dgRNA
  Gps1
cgccgcgtggccgtt

SEQ ID NO: 79004 - DNA, 15 bp, Artificial Sequence
  dgRNA
  Lipm
gaactaagcataagg

SEQ ID NO: 79005 - DNA, 15 bp, Artificial Sequence
  dgRNA
  Lipm
tttatggcctctaca

SEQ ID NO: 79006 - DNA, 15 bp, Artificial Sequence
  dgRNA
  Lipm
gcctctacatggtga

SEQ ID NO: 79007 - DNA, 15 bp, Artificial Sequence
  dgRNA
  Lipm
cctctacatggtgac

SEQ ID NO: 79008 - DNA, 15 bp, Artificial Sequence
  dgRNA
  Abca7
ggtgccttgtttgcc

SEQ ID NO: 79009 - DNA, 15 bp, Artificial Sequence
  dgRNA
  Abca7
ttgccgggctctttg

SEQ ID NO: 79010 - DNA, 15 bp, Artificial Sequence
  dgRNA
  Abca7
tgccgggctctttgc

SEQ ID NO: 79011 - DNA, 15 bp, Artificial Sequence
  dgRNA
  Abca7
gcgggagatttattg

SEQ ID NO: 79012 - DNA, 15 bp, Artificial Sequence
  dgRNA
  Mptx2
gtgtagctcttatat

SEQ ID NO: 79013 - DNA, 15 bp, Artificial Sequence
  dgRNA
  Tph2
caaacaaatctcatc

SEQ ID NO: 79014 - DNA, 15 bp, Artificial Sequence
  dgRNA
  Tph2
cgtgtaatctgactg

SEQ ID NO: 79015 - DNA, 15 bp, Artificial Sequence
  dgRNA
  Tph2
cagtcactcatataa

SEQ ID NO: 79016 - DNA, 15 bp, Artificial Sequence
  dgRNA
  Tph2
atataaaggaacacg

SEQ ID NO: 79017 - DNA, 15 bp, Artificial Sequence
  dgRNA
  Dsg1b
cccttagcttttacc

SEQ ID NO: 79018 - DNA, 15 bp, Artificial Sequence
  dgRNA
  Dsg1b
ccaggtaaaagctaa

SEQ ID NO: 79019 - DNA, 15 bp, Artificial Sequence
  dgRNA
  Tbc1d10b
cctccgcgtctgcgc

SEQ ID NO: 79020 - DNA, 15 bp, Artificial Sequence
  dgRNA
  Tbc1d10b
gcgcaggcgcgacgt

SEQ ID NO: 79021 - DNA, 15 bp, Artificial Sequence
  dgRNA
  Tbc1d10b
cgcgacgtcggcagc

SEQ ID NO: 79022 - DNA, 15 bp, Artificial Sequence
  dgRNA
  Tbc1d10b
cagccggcccctcgc

SEQ ID NO: 79023 - DNA, 15 bp, Artificial Sequence
  dgRNA
  Mdga2
tggggtattgtgtag

SEQ ID NO: 79024 - DNA, 15 bp, Artificial Sequence
  dgRNA
  Lhb
ctaagccctgacacc

SEQ ID NO: 79025 - DNA, 15 bp, Artificial Sequence
  dgRNA
  Lhb
taagccctgacacct

SEQ ID NO: 79026 - DNA, 15 bp, Artificial Sequence
  dgRNA
  Lhb
tgaggccaattcact

SEQ ID NO: 79027 - DNA, 15 bp, Artificial Sequence
  dgRNA
  Lhb
actggagctagtccc

SEQ ID NO: 79028 - DNA, 15 bp, Artificial Sequence
  dgRNA
  Xntrpc
aagtcccactcgcta

SEQ ID NO: 79029 - DNA, 15 bp, Artificial Sequence
  dgRNA
  Xntrpc
agtcccactcgctaa

SEQ ID NO: 79030 - DNA, 15 bp, Artificial Sequence
  dgRNA
  Xntrpc
cccactcgctaaggg

SEQ ID NO: 79031 - DNA, 15 bp, Artificial Sequence
  dgRNA
  Xntrpc
tcgctaagggcggac

SEQ ID NO: 79032 - DNA, 15 bp, Artificial Sequence
  dgRNA
  Taf6l
tgttagctaacccaa

SEQ ID NO: 79033 - DNA, 15 bp, Artificial Sequence
  dgRNA
  Taf6l
ccaacgtcgccctag

SEQ ID NO: 79034 - DNA, 15 bp, Artificial Sequence
  dgRNA
  Taf6l
tggccaatcttgagg

SEQ ID NO: 79035 - DNA, 15 bp, Artificial Sequence
  dgRNA
  Taf6l
ggtggtatgcctctt

SEQ ID NO: 79036 - DNA, 15 bp, Artificial Sequence
  dgRNA
  Mertk
ccgggcctgagccct

SEQ ID NO: 79037 - DNA, 15 bp, Artificial Sequence
  dgRNA
  Mertk
cgcctcttctaactt

SEQ ID NO: 79038 - DNA, 15 bp, Artificial Sequence
  dgRNA
  Mertk
tccgcactgccactc

SEQ ID NO: 79039 - DNA, 15 bp, Artificial Sequence
  dgRNA
  Mertk
tgctgcccgggcggc

SEQ ID NO: 79040 - DNA, 15 bp, Artificial Sequence
  dgRNA
  Gpx8
ttcgtttgattcttc

SEQ ID NO: 79041 - DNA, 15 bp, Artificial Sequence
  dgRNA
  Gpx8
tcgtttgattcttct

SEQ ID NO: 79042 - DNA, 15 bp, Artificial Sequence
  dgRNA
  Gpx8
ctcttcagcagccga

SEQ ID NO: 79043 - DNA, 15 bp, Artificial Sequence
  dgRNA
  Gpx8
tcttcagcagccgaa

SEQ ID NO: 79044 - DNA, 15 bp, Artificial Sequence
  dgRNA
  Emsy
gctgggaaagaccgg

SEQ ID NO: 79045 - DNA, 15 bp, Artificial Sequence
  dgRNA
  Emsy
gaaagaccggaggat

SEQ ID NO: 79046 - DNA, 15 bp, Artificial Sequence
  dgRNA
  Emsy
ataggcgcgcgaagc

SEQ ID NO: 79047 - DNA, 15 bp, Artificial Sequence
  dgRNA
  Emsy
cgcgaagctggagac

SEQ ID NO: 79048 - DNA, 15 bp, Artificial Sequence
  dgRNA
  Il22ra2
attggtggagcccaa

SEQ ID NO: 79049 - DNA, 15 bp, Artificial Sequence
  dgRNA
  Il22ra2
gcccaacggaagtga

SEQ ID NO: 79050 - DNA, 15 bp, Artificial Sequence
  dgRNA
  Il22ra2
gtgacggtccatttg

SEQ ID NO: 79051 - DNA, 15 bp, Artificial Sequence
  dgRNA
  Il22ra2
gttgggctccaccaa

SEQ ID NO: 79052 - DNA, 15 bp, Artificial Sequence
  dgRNA
  9530002B09Rik
gggaggtaatctttg

SEQ ID NO: 79053 - DNA, 15 bp, Artificial Sequence
  dgRNA
  9530002B09Rik
ggaggtaatctttga

SEQ ID NO: 79054 - DNA, 15 bp, Artificial Sequence
  dgRNA
  9530002B09Rik
gaggtaatctttgag

SEQ ID NO: 79055 - DNA, 15 bp, Artificial Sequence
  dgRNA
  9530002B09Rik
aggtaatctttgagg

SEQ ID NO: 79056 - DNA, 15 bp, Artificial Sequence
  dgRNA
  Olfr1246
ctaaatatctactgc

SEQ ID NO: 79057 - DNA, 15 bp, Artificial Sequence
  dgRNA
  Olfr1246
ctccccatgtcatga

SEQ ID NO: 79058 - DNA, 15 bp, Artificial Sequence
  dgRNA
  Gtpbp10
caacttagacgaatc

SEQ ID NO: 79059 - DNA, 15 bp, Artificial Sequence
  dgRNA
  Gtpbp10
aacttagacgaatct

SEQ ID NO: 79060 - DNA, 15 bp, Artificial Sequence
  dgRNA
  Gtpbp10
cgcgatgcagcacgc

SEQ ID NO: 79061 - DNA, 15 bp, Artificial Sequence
  dgRNA
  Gtpbp10
tgcagcacgcaggcg

SEQ ID NO: 79062 - DNA, 15 bp, Artificial Sequence
  dgRNA
  Coq6
tgacaaccgtgacag

SEQ ID NO: 79063 - DNA, 15 bp, Artificial Sequence
  dgRNA
  Coq6
ccgtgacagcggcgc

SEQ ID NO: 79064 - DNA, 15 bp, Artificial Sequence
  dgRNA
  Coq6
tgacagcggcgccgg

SEQ ID NO: 79065 - DNA, 15 bp, Artificial Sequence
  dgRNA
  Coq6
gcggcgccggcggtt

SEQ ID NO: 79066 - DNA, 15 bp, Artificial Sequence
  dgRNA
  Omt2b
gtagcactagtttat

SEQ ID NO: 79067 - DNA, 15 bp, Artificial Sequence
  dgRNA
  Omt2b
ggagccctggccaat

SEQ ID NO: 79068 - DNA, 15 bp, Artificial Sequence
  dgRNA
  Omt2b
gctctctttcaccaa

SEQ ID NO: 79069 - DNA, 15 bp, Artificial Sequence
  dgRNA
  Omt2b
ctagtgctacatcta

SEQ ID NO: 79070 - DNA, 15 bp, Artificial Sequence
  dgRNA
  Ppfia3
acgctgcatgcctat

SEQ ID NO: 79071 - DNA, 15 bp, Artificial Sequence
  dgRNA
  Ppfia3
agctctccgcccgcg

SEQ ID NO: 79072 - DNA, 15 bp, Artificial Sequence
  dgRNA
  Ppfia3
tccctcccgatgtgg

SEQ ID NO: 79073 - DNA, 15 bp, Artificial Sequence
  dgRNA
  Ppfia3
ctcccgatgtggagg

SEQ ID NO: 79074 - DNA, 15 bp, Artificial Sequence
  dgRNA
  Fxyd1
cgggcaggcggccga

SEQ ID NO: 79075 - DNA, 15 bp, Artificial Sequence
  dgRNA
  Phf24
tgccggctgctcgtg

SEQ ID NO: 79076 - DNA, 15 bp, Artificial Sequence
  dgRNA
  Phf24
gccggctgctcgtgc

SEQ ID NO: 79077 - DNA, 15 bp, Artificial Sequence
  dgRNA
  Phf24
cgcgccccacgcccg

SEQ ID NO: 79078 - DNA, 15 bp, Artificial Sequence
  dgRNA
  Phf24
cgcccgcggccgagc

SEQ ID NO: 79079 - DNA, 15 bp, Artificial Sequence
  dgRNA
  Tff1
tcaagggaggtactc

SEQ ID NO: 79080 - DNA, 15 bp, Artificial Sequence
  dgRNA
  Tff1
agtgtatcttacgag

SEQ ID NO: 79081 - DNA, 15 bp, Artificial Sequence
  dgRNA
  Tff1
gtgtatcttacgaga

SEQ ID NO: 79082 - DNA, 15 bp, Artificial Sequence
  dgRNA
  Tff1
taatcttacccagca

SEQ ID NO: 79083 - DNA, 15 bp, Artificial Sequence
  dgRNA
  Cutal
aagtaagctcggaag

SEQ ID NO: 79084 - DNA, 15 bp, Artificial Sequence
  dgRNA
  Kcnj1
gcagcctaacacctt

SEQ ID NO: 79085 - DNA, 15 bp, Artificial Sequence
  dgRNA
  Kcnj1
cacgcctactcttgt

SEQ ID NO: 79086 - DNA, 15 bp, Artificial Sequence
  dgRNA
  Kcnj1
tactcttgttggatc

SEQ ID NO: 79087 - DNA, 15 bp, Artificial Sequence
  dgRNA
  Kcnj1
tacaccgaaggtgtt

SEQ ID NO: 79088 - DNA, 15 bp, Artificial Sequence
  dgRNA
  Zfp810
accctgtccaatcga

SEQ ID NO: 79089 - DNA, 15 bp, Artificial Sequence
  dgRNA
  Zfp810
tccaatcgaaggcgc

SEQ ID NO: 79090 - DNA, 15 bp, Artificial Sequence
  dgRNA
  Zfp810
ccaatcgaaggcgcc

SEQ ID NO: 79091 - DNA, 15 bp, Artificial Sequence
  dgRNA
  Zfp810
caatcgaaggcgccg

SEQ ID NO: 79092 - DNA, 15 bp, Artificial Sequence
  dgRNA
  Zfp358
gtgcatggagggtta

SEQ ID NO: 79093 - DNA, 15 bp, Artificial Sequence
  dgRNA
  Zfp358
gggttagggtggcgc

SEQ ID NO: 79094 - DNA, 15 bp, Artificial Sequence
  dgRNA
  Zfp358
tagggtggcgcgggt

SEQ ID NO: 79095 - DNA, 15 bp, Artificial Sequence
  dgRNA
  Zfp358
gtggcgcgggttggt

SEQ ID NO: 79096 - DNA, 15 bp, Artificial Sequence
  dgRNA
  1700112E06Rik
aatgcaataaagctc

SEQ ID NO: 79097 - DNA, 15 bp, Artificial Sequence
  dgRNA
  1700112E06Rik
atgcaataaagctct

SEQ ID NO: 79098 - DNA, 15 bp, Artificial Sequence
  dgRNA
  1700112E06Rik
gcattggattctgga

SEQ ID NO: 79099 - DNA, 15 bp, Artificial Sequence
  dgRNA
  1700112E06Rik
gaaggggcacctttt

SEQ ID NO: 79100 - DNA, 15 bp, Artificial Sequence
  dgRNA
  Olfr187
ctcctcacatgcgtc

SEQ ID NO: 79101 - DNA, 15 bp, Artificial Sequence
  dgRNA
  Olfr187
tctctatggggaatg

SEQ ID NO: 79102 - DNA, 15 bp, Artificial Sequence
  dgRNA
  Olfr187
ctctatggggaatgc

SEQ ID NO: 79103 - DNA, 15 bp, Artificial Sequence
  dgRNA
  Olfr187
gaatgcgggagttcc

SEQ ID NO: 79104 - DNA, 15 bp, Artificial Sequence
  dgRNA
  Mtnr1b
cttcttaacactcac

SEQ ID NO: 79105 - DNA, 15 bp, Artificial Sequence
  dgRNA
  Mtnr1b
taacactcactgggc

SEQ ID NO: 79106 - DNA, 15 bp, Artificial Sequence
  dgRNA
  Mtnr1b
aacactcactgggcg

SEQ ID NO: 79107 - DNA, 15 bp, Artificial Sequence
  dgRNA
  Mtnr1b
ttgtgcatctatccc

SEQ ID NO: 79108 - DNA, 15 bp, Artificial Sequence
  dgRNA
  Cfap58
aggggcacggttcct

SEQ ID NO: 79109 - DNA, 15 bp, Artificial Sequence
  dgRNA
  Cfap58
tctgcggaccactgc

SEQ ID NO: 79110 - DNA, 15 bp, Artificial Sequence
  dgRNA
  Cfap58
ctgcggaccactgcc

SEQ ID NO: 79111 - DNA, 15 bp, Artificial Sequence
  dgRNA
  Cfap58
ccgggtaccgaccta

SEQ ID NO: 79112 - DNA, 15 bp, Artificial Sequence
  dgRNA
  Gpnmb
cgagttgttaagcga

SEQ ID NO: 79113 - DNA, 15 bp, Artificial Sequence
  dgRNA
  Gpnmb
ttaagcgatggaatt

SEQ ID NO: 79114 - DNA, 15 bp, Artificial Sequence
  dgRNA
  Gpnmb
taagcgatggaattt

SEQ ID NO: 79115 - DNA, 15 bp, Artificial Sequence
  dgRNA
  Gpnmb
ctttcctagcttaaa

SEQ ID NO: 79116 - DNA, 15 bp, Artificial Sequence
  dgRNA
  2300002M23Rik
ccgggtgctctataa

SEQ ID NO: 79117 - DNA, 15 bp, Artificial Sequence
  dgRNA
  2300002M23Rik
taatggtagagcacc

SEQ ID NO: 79118 - DNA, 15 bp, Artificial Sequence
  dgRNA
  2300002M23Rik
accgaatcaagaatg

SEQ ID NO: 79119 - DNA, 15 bp, Artificial Sequence
  dgRNA
  2300002M23Rik
ccgaatcaagaatga

SEQ ID NO: 79120 - DNA, 15 bp, Artificial Sequence
  dgRNA
  Apaf1
tgtttgagtgctccg

SEQ ID NO: 79121 - DNA, 15 bp, Artificial Sequence
  dgRNA
  Apaf1
tgctccgcggtcctg

SEQ ID NO: 79122 - DNA, 15 bp, Artificial Sequence
  dgRNA
  Ak3
gaacggggtgctcag

SEQ ID NO: 79123 - DNA, 15 bp, Artificial Sequence
  dgRNA
  Ak3
cagaggttgtccact

SEQ ID NO: 79124 - DNA, 15 bp, Artificial Sequence
  dgRNA
  Ak3
acgggcgcagcctgc

SEQ ID NO: 79125 - DNA, 15 bp, Artificial Sequence
  dgRNA
  Ak3
cagggcacgagggtc

SEQ ID NO: 79126 - DNA, 15 bp, Artificial Sequence
  dgRNA
  Slc25a23
taccaaaaccattta

SEQ ID NO: 79127 - DNA, 15 bp, Artificial Sequence
  dgRNA
  Slc25a23
ctctcctaccgtccc

SEQ ID NO: 79128 - DNA, 15 bp, Artificial Sequence
  dgRNA
  Slc25a23
ctcccccaagtaatg

SEQ ID NO: 79129 - DNA, 15 bp, Artificial Sequence
  dgRNA
  Slc25a23
tcccccaagtaatgc

SEQ ID NO: 79130 - DNA, 15 bp, Artificial Sequence
  dgRNA
  Mlec
gccccgtggttgggc

SEQ ID NO: 79131 - DNA, 15 bp, Artificial Sequence
  dgRNA
  Mlec
gttgggccggagcct

SEQ ID NO: 79132 - DNA, 15 bp, Artificial Sequence
  dgRNA
  Mlec
gccggagcctaggcg

SEQ ID NO: 79133 - DNA, 15 bp, Artificial Sequence
  dgRNA
  Mlec
ggacgcaccagccaa

SEQ ID NO: 79134 - DNA, 15 bp, Artificial Sequence
  dgRNA
  Zfp414
tgggctataaaagtg

SEQ ID NO: 79135 - DNA, 15 bp, Artificial Sequence
  dgRNA
  Zfp414
gaagcgcccagaatt

SEQ ID NO: 79136 - DNA, 15 bp, Artificial Sequence
  dgRNA
  Zfp414
cgcttctctagaagg

SEQ ID NO: 79137 - DNA, 15 bp, Artificial Sequence
  dgRNA
  Zfp414
gggcgcttctctaga

SEQ ID NO: 79138 - DNA, 15 bp, Artificial Sequence
  dgRNA
  BC024139
cgtacaggaactgtg

SEQ ID NO: 79139 - DNA, 15 bp, Artificial Sequence
  dgRNA
  BC024139
ttcctaggaaacggg

SEQ ID NO: 79140 - DNA, 15 bp, Artificial Sequence
  dgRNA
  BC024139
ggggccagactgtct

SEQ ID NO: 79141 - DNA, 15 bp, Artificial Sequence
  dgRNA
  Tnfrsf11b
cctgaggctagccgc

SEQ ID NO: 79142 - DNA, 15 bp, Artificial Sequence
  dgRNA
  Tnfrsf11b
cttcggaactcccag

SEQ ID NO: 79143 - DNA, 15 bp, Artificial Sequence
  dgRNA
  Tnfrsf11b
ggctgagtacacttg

SEQ ID NO: 79144 - DNA, 15 bp, Artificial Sequence
  dgRNA
  Tnfrsf11b
cagcggctagcctca

SEQ ID NO: 79145 - DNA, 15 bp, Artificial Sequence
  dgRNA
  Pi15
cccaatctctgttgt

SEQ ID NO: 79146 - DNA, 15 bp, Artificial Sequence
  dgRNA
  Pi15
ggcaacctttttatg

SEQ ID NO: 79147 - DNA, 15 bp, Artificial Sequence
  dgRNA
  Pi15
ccaaaatccaagggg

SEQ ID NO: 79148 - DNA, 15 bp, Artificial Sequence
  dgRNA
  Pi15
cagccaaaatccaag

SEQ ID NO: 79149 - DNA, 15 bp, Artificial Sequence
  dgRNA
  Olfr373
cctccggccgctcac

SEQ ID NO: 79150 - DNA, 15 bp, Artificial Sequence
  dgRNA
  Olfr373
cggccgctcactggt

SEQ ID NO: 79151 - DNA, 15 bp, Artificial Sequence
  dgRNA
  Olfr373
gtgagcggccggagg

SEQ ID NO: 79152 - DNA, 15 bp, Artificial Sequence
  dgRNA
  Olfr373
cggtagggtcccact

SEQ ID NO: 79153 - DNA, 15 bp, Artificial Sequence
  dgRNA
  Dock2
cggaagagacaaatg

SEQ ID NO: 79154 - DNA, 15 bp, Artificial Sequence
  dgRNA
  Dock2
ggctacaaggcatac

SEQ ID NO: 79155 - DNA, 15 bp, Artificial Sequence
  dgRNA
  Dock2
atttgtctcttccgg

SEQ ID NO: 79156 - DNA, 15 bp, Artificial Sequence
  dgRNA
  Golt1b
aaccttcccgccgcc

SEQ ID NO: 79157 - DNA, 15 bp, Artificial Sequence
  dgRNA
  Golt1b
cagcgcccacccttc

SEQ ID NO: 79158 - DNA, 15 bp, Artificial Sequence
  dgRNA
  Golt1b
ctctgattggctgcg

SEQ ID NO: 79159 - DNA, 15 bp, Artificial Sequence
  dgRNA
  Golt1b
attggctgcgtggtg

SEQ ID NO: 79160 - DNA, 15 bp, Artificial Sequence
  dgRNA
  Hps3
agcgctcacgtgatc

SEQ ID NO: 79161 - DNA, 15 bp, Artificial Sequence
  dgRNA
  Kcnip3
cgcgcggcctccccg

SEQ ID NO: 79162 - DNA, 15 bp, Artificial Sequence
  dgRNA
  Kcnip3
cggcctccccgaggc

SEQ ID NO: 79163 - DNA, 15 bp, Artificial Sequence
  dgRNA
  Kcnip3
ctggcgggggagtcg

SEQ ID NO: 79164 - DNA, 15 bp, Artificial Sequence
  dgRNA
  Kcnip3
tcgtggcgaccagcc

SEQ ID NO: 79165 - DNA, 15 bp, Artificial Sequence
  dgRNA
  Necab2
ccgggacccctattc

SEQ ID NO: 79166 - DNA, 15 bp, Artificial Sequence
  dgRNA
  Necab2
ggcaactagcgcccg

SEQ ID NO: 79167 - DNA, 15 bp, Artificial Sequence
  dgRNA
  Necab2
gcaactagcgcccgc

SEQ ID NO: 79168 - DNA, 15 bp, Artificial Sequence
  dgRNA
  Necab2
actagcgcccgcggg

SEQ ID NO: 79169 - DNA, 15 bp, Artificial Sequence
  dgRNA
  Olfr873
tcaccataactgaga

SEQ ID NO: 79170 - DNA, 15 bp, Artificial Sequence
  dgRNA
  Olfr873
caccataactgagat

SEQ ID NO: 79171 - DNA, 15 bp, Artificial Sequence
  dgRNA
  Olfr873
accataactgagatg

SEQ ID NO: 79172 - DNA, 15 bp, Artificial Sequence
  dgRNA
  Olfr873
gattgatgggggtaa

SEQ ID NO: 79173 - DNA, 15 bp, Artificial Sequence
  dgRNA
  Tmem207
taacaaacagtccct

SEQ ID NO: 79174 - DNA, 15 bp, Artificial Sequence
  dgRNA
  Tmem207
ctggatgccctttcg

SEQ ID NO: 79175 - DNA, 15 bp, Artificial Sequence
  dgRNA
  Tmem207
ggtactaggagctca

SEQ ID NO: 79176 - DNA, 15 bp, Artificial Sequence
  dgRNA
  Tmem207
atgctcacaggtact

SEQ ID NO: 79177 - DNA, 15 bp, Artificial Sequence
  dgRNA
  Stag2
cggaagcggggagtc

SEQ ID NO: 79178 - DNA, 15 bp, Artificial Sequence
  dgRNA
  Stag2
aagcggggagtccgg

SEQ ID NO: 79179 - DNA, 15 bp, Artificial Sequence
  dgRNA
  Stag2
cggggagtccggcgg

SEQ ID NO: 79180 - DNA, 15 bp, Artificial Sequence
  dgRNA
  Stag2
gcggcggcgattggt

SEQ ID NO: 79181 - DNA, 15 bp, Artificial Sequence
  dgRNA
  Cmss1
aataacccaaaccga

SEQ ID NO: 79182 - DNA, 15 bp, Artificial Sequence
  dgRNA
  Cmss1
aaacggcgacacccc

SEQ ID NO: 79183 - DNA, 15 bp, Artificial Sequence
  dgRNA
  Cmss1
tgacgtcatctccag

SEQ ID NO: 79184 - DNA, 15 bp, Artificial Sequence
  dgRNA
  Cmss1
tcatctccagtggcg

SEQ ID NO: 79185 - DNA, 15 bp, Artificial Sequence
  dgRNA
  Skiv2l
gcggcgatgacgtaa

SEQ ID NO: 79186 - DNA, 15 bp, Artificial Sequence
  dgRNA
  Skiv2l
cggcgatgacgtaaa

SEQ ID NO: 79187 - DNA, 15 bp, Artificial Sequence
  dgRNA
  Skiv2l
ggcgatgacgtaaag

SEQ ID NO: 79188 - DNA, 15 bp, Artificial Sequence
  dgRNA
  Skiv2l
gatgacgtaaagggg

SEQ ID NO: 79189 - DNA, 15 bp, Artificial Sequence
  dgRNA
  Smc5
cacatcgcacctctg

SEQ ID NO: 79190 - DNA, 15 bp, Artificial Sequence
  dgRNA
  Smc5
gccaccggggagcgt

SEQ ID NO: 79191 - DNA, 15 bp, Artificial Sequence
  dgRNA
  Smc5
ccggggagcgttggt

SEQ ID NO: 79192 - DNA, 15 bp, Artificial Sequence
  dgRNA
  Smc5
cggggagcgttggtc

SEQ ID NO: 79193 - DNA, 15 bp, Artificial Sequence
  dgRNA
  Dach1
aactttgtgctagag

SEQ ID NO: 79194 - DNA, 15 bp, Artificial Sequence
  dgRNA
  Dach1
actttgtgctagagc

SEQ ID NO: 79195 - DNA, 15 bp, Artificial Sequence
  dgRNA
  Dach1
tcgcatttcgacttg

SEQ ID NO: 79196 - DNA, 15 bp, Artificial Sequence
  dgRNA
  Dach1
cgcatttcgacttgc

SEQ ID NO: 79197 - DNA, 15 bp, Artificial Sequence
  dgRNA
  Olfr1205
ctagacaatggtaag

SEQ ID NO: 79198 - DNA, 15 bp, Artificial Sequence
  dgRNA
  Olfr1205
taagtggtaactcac

SEQ ID NO: 79199 - DNA, 15 bp, Artificial Sequence
  dgRNA
  Olfr1205
cttacaaatttagca

SEQ ID NO: 79200 - DNA, 15 bp, Artificial Sequence
  dgRNA
  Olfr1205
ttttcagattcgttc

SEQ ID NO: 79201 - DNA, 15 bp, Artificial Sequence
  dgRNA
  Ssc5d
gagcacgtggccctc

SEQ ID NO: 79202 - DNA, 15 bp, Artificial Sequence
  dgRNA
  Ssc5d
cgcctccctccagtg

SEQ ID NO: 79203 - DNA, 15 bp, Artificial Sequence
  dgRNA
  Pddc1
ggggaggatacgccc

SEQ ID NO: 79204 - DNA, 15 bp, Artificial Sequence
  dgRNA
  Pddc1
agcatgcgaggggcg

SEQ ID NO: 79205 - DNA, 15 bp, Artificial Sequence
  dgRNA
  Pddc1
aagcatgcgaggggc

SEQ ID NO: 79206 - DNA, 15 bp, Artificial Sequence
  dgRNA
  Pddc1
tggcaagcatgcgag

SEQ ID NO: 79207 - DNA, 15 bp, Artificial Sequence
  dgRNA
  Mup21
cattcactgttctcg

SEQ ID NO: 79208 - DNA, 15 bp, Artificial Sequence
  dgRNA
  Mup21
attcactgttctcgt

SEQ ID NO: 79209 - DNA, 15 bp, Artificial Sequence
  dgRNA
  Mup21
acgaaatcaatcttt

SEQ ID NO: 79210 - DNA, 15 bp, Artificial Sequence
  dgRNA
  Mup21
gcctgactgagctaa

SEQ ID NO: 79211 - DNA, 15 bp, Artificial Sequence
  dgRNA
  Jph3
cgcgagacgctggtc

SEQ ID NO: 79212 - DNA, 15 bp, Artificial Sequence
  dgRNA
  Jph3
acgctggtcaggctc

SEQ ID NO: 79213 - DNA, 15 bp, Artificial Sequence
  dgRNA
  Jph3
atgaacaatcgccgc

SEQ ID NO: 79214 - DNA, 15 bp, Artificial Sequence
  dgRNA
  Jph3
aacaatcgccgctgg

SEQ ID NO: 79215 - DNA, 15 bp, Artificial Sequence
  dgRNA
  Zfp616
agtaacactaatcca

SEQ ID NO: 79216 - DNA, 15 bp, Artificial Sequence
  dgRNA
  Sirt2
tttccgctgccgtca

SEQ ID NO: 79217 - DNA, 15 bp, Artificial Sequence
  dgRNA
  Sirt2
ttccgctgccgtcac

SEQ ID NO: 79218 - DNA, 15 bp, Artificial Sequence
  dgRNA
  Sirt2
gtcccgtgacggcag

SEQ ID NO: 79219 - DNA, 15 bp, Artificial Sequence
  dgRNA
  Sirt2
tgctctgtcccgtga

SEQ ID NO: 79220 - DNA, 15 bp, Artificial Sequence
  dgRNA
  Gimap3
gtggtgtggccgatg

SEQ ID NO: 79221 - DNA, 15 bp, Artificial Sequence
  dgRNA
  Gimap3
tggtgtggccgatga

SEQ ID NO: 79222 - DNA, 15 bp, Artificial Sequence
  dgRNA
  Gimap3
tgtggccgatgaggg

SEQ ID NO: 79223 - DNA, 15 bp, Artificial Sequence
  dgRNA
  Gimap3
cgatgagggtggagc

SEQ ID NO: 79224 - DNA, 15 bp, Artificial Sequence
  dgRNA
  Cbx8
ctggctattggaacg

SEQ ID NO: 79225 - DNA, 15 bp, Artificial Sequence
  dgRNA
  Cbx8
tggctattggaacgc

SEQ ID NO: 79226 - DNA, 15 bp, Artificial Sequence
  dgRNA
  Cbx8
gtcacgtagcaacgc

SEQ ID NO: 79227 - DNA, 15 bp, Artificial Sequence
  dgRNA
  Cbx8
tcacgtagcaacgca

SEQ ID NO: 79228 - DNA, 15 bp, Artificial Sequence
  dgRNA
  Tcf7l2
gattgaatgctgggt

SEQ ID NO: 79229 - DNA, 15 bp, Artificial Sequence
  dgRNA
  Tcf7l2
attgaatgctgggtt

SEQ ID NO: 79230 - DNA, 15 bp, Artificial Sequence
  dgRNA
  Tcf7l2
tgttgtggaaccgac

SEQ ID NO: 79231 - DNA, 15 bp, Artificial Sequence
  dgRNA
  Tcf7l2
gttgtggaaccgacc

SEQ ID NO: 79232 - DNA, 15 bp, Artificial Sequence
  dgRNA
  Kdelc1
ggacgaaagtagttg

SEQ ID NO: 79233 - DNA, 15 bp, Artificial Sequence
  dgRNA
  Kdelc1
gacgaaagtagttgg

SEQ ID NO: 79234 - DNA, 15 bp, Artificial Sequence
  dgRNA
  Kdelc1
ttgggggtgaactcc

SEQ ID NO: 79235 - DNA, 15 bp, Artificial Sequence
  dgRNA
  Kdelc1
gggtgaactcctggc

SEQ ID NO: 79236 - DNA, 15 bp, Artificial Sequence
  dgRNA
  Dimt1
cagccttgcctccgg

SEQ ID NO: 79237 - DNA, 15 bp, Artificial Sequence
  dgRNA
  Dimt1
gagtccgccttgccg

SEQ ID NO: 79238 - DNA, 15 bp, Artificial Sequence
  dgRNA
  Dimt1
agtccgccttgccgc

SEQ ID NO: 79239 - DNA, 15 bp, Artificial Sequence
  dgRNA
  Dimt1
ccgccttgccgcggg

SEQ ID NO: 79240 - DNA, 15 bp, Artificial Sequence
  dgRNA
  Sgcg
agggtttatatgtcg

SEQ ID NO: 79241 - DNA, 15 bp, Artificial Sequence
  dgRNA
  Sgcg
tatatgtcggggtgc

SEQ ID NO: 79242 - DNA, 15 bp, Artificial Sequence
  dgRNA
  Sgcg
ctttgccccaatggt

SEQ ID NO: 79243 - DNA, 15 bp, Artificial Sequence
  dgRNA
  Sgcg
tttgccccaatggtt

SEQ ID NO: 79244 - DNA, 15 bp, Artificial Sequence
  dgRNA
  Rad54b
gatctagcagtcaac

SEQ ID NO: 79245 - DNA, 15 bp, Artificial Sequence
  dgRNA
  Rad54b
ctagacccacgtaaa

SEQ ID NO: 79246 - DNA, 15 bp, Artificial Sequence
  dgRNA
  Rad54b
ttgtccaatcagagt

SEQ ID NO: 79247 - DNA, 15 bp, Artificial Sequence
  dgRNA
  Rad54b
gtccaatcagagtcg

SEQ ID NO: 79248 - DNA, 15 bp, Artificial Sequence
  dgRNA
  Rptn
gcaaacggtttccag

SEQ ID NO: 79249 - DNA, 15 bp, Artificial Sequence
  dgRNA
  Rptn
caaacggtttccaga

SEQ ID NO: 79250 - DNA, 15 bp, Artificial Sequence
  dgRNA
  Rptn
caagctggattgaac

SEQ ID NO: 79251 - DNA, 15 bp, Artificial Sequence
  dgRNA
  Rptn
ccctaccaacagaat

SEQ ID NO: 79252 - DNA, 15 bp, Artificial Sequence
  dgRNA
  BC051628
aattccactagcccg

SEQ ID NO: 79253 - DNA, 15 bp, Artificial Sequence
  dgRNA
  BC051628
cactagcccgtggcg

SEQ ID NO: 79254 - DNA, 15 bp, Artificial Sequence
  dgRNA
  BC051628
actagcccgtggcgc

SEQ ID NO: 79255 - DNA, 15 bp, Artificial Sequence
  dgRNA
  BC051628
tgtttcgagtccgtg

SEQ ID NO: 79256 - DNA, 15 bp, Artificial Sequence
  dgRNA
  Csrnp3
acagcttcttatggt

SEQ ID NO: 79257 - DNA, 15 bp, Artificial Sequence
  dgRNA
  Csrnp3
taaacaagtaacgca

SEQ ID NO: 79258 - DNA, 15 bp, Artificial Sequence
  dgRNA
  Csrnp3
tcttttatccgttaa

SEQ ID NO: 79259 - DNA, 15 bp, Artificial Sequence
  dgRNA
  Csrnp3
cgttaatggacatag

SEQ ID NO: 79260 - DNA, 15 bp, Artificial Sequence
  dgRNA
  Bid
tcccccgtagcgagc

SEQ ID NO: 79261 - DNA, 15 bp, Artificial Sequence
  dgRNA
  Bid
ccgtagcgagccggt

SEQ ID NO: 79262 - DNA, 15 bp, Artificial Sequence
  dgRNA
  Bid
agccggtaggaccct

SEQ ID NO: 79263 - DNA, 15 bp, Artificial Sequence
  dgRNA
  Bid
gccggtaggaccctt

SEQ ID NO: 79264 - DNA, 15 bp, Artificial Sequence
  dgRNA
  Mpst
cctttggctggccgc

SEQ ID NO: 79265 - DNA, 15 bp, Artificial Sequence
  dgRNA
  Mpst
tggctggccgcaggt

SEQ ID NO: 79266 - DNA, 15 bp, Artificial Sequence
  dgRNA
  Mpst
ctggccgcaggttgg

SEQ ID NO: 79267 - DNA, 15 bp, Artificial Sequence
  dgRNA
  Mpst
gccgcaggttggtgg

SEQ ID NO: 79268 - DNA, 15 bp, Artificial Sequence
  dgRNA
  Arid3a
ccgtccactctgtgg

SEQ ID NO: 79269 - DNA, 15 bp, Artificial Sequence
  dgRNA
  Arid3a
tctgtggcggctctc

SEQ ID NO: 79270 - DNA, 15 bp, Artificial Sequence
  dgRNA
  Arid3a
tggacggaaaacttc

SEQ ID NO: 79271 - DNA, 15 bp, Artificial Sequence
  dgRNA
  Arid3a
ccgccacagagtgga

SEQ ID NO: 79272 - DNA, 15 bp, Artificial Sequence
  dgRNA
  Arhgap4
caacctcaacatgtc

SEQ ID NO: 79273 - DNA, 15 bp, Artificial Sequence
  dgRNA
  Tph1
gagtcacttgaggat

SEQ ID NO: 79274 - DNA, 15 bp, Artificial Sequence
  dgRNA
  Tnfsf14
caagtacatcggagc

SEQ ID NO: 79275 - DNA, 15 bp, Artificial Sequence
  dgRNA
  Tnfsf14
aagtacatcggagca

SEQ ID NO: 79276 - DNA, 15 bp, Artificial Sequence
  dgRNA
  Tnfsf14
agtacatcggagcag

SEQ ID NO: 79277 - DNA, 15 bp, Artificial Sequence
  dgRNA
  Tnfsf14
gtgagagtgatcgac

SEQ ID NO: 79278 - DNA, 15 bp, Artificial Sequence
  dgRNA
  Tmem175
gcagcgacatggcgt

SEQ ID NO: 79279 - DNA, 15 bp, Artificial Sequence
  dgRNA
  Tmem175
gcgtcggccgctccg

SEQ ID NO: 79280 - DNA, 15 bp, Artificial Sequence
  dgRNA
  Tmem175
gccgctccgcggcag

SEQ ID NO: 79281 - DNA, 15 bp, Artificial Sequence
  dgRNA
  Tmem175
ccgctccgcggcagc

SEQ ID NO: 79282 - DNA, 15 bp, Artificial Sequence
  dgRNA
  Gnptab
gtcccaccgtgcaga

SEQ ID NO: 79283 - DNA, 15 bp, Artificial Sequence
  dgRNA
  Gnptab
ggcagagggcccaaa

SEQ ID NO: 79284 - DNA, 15 bp, Artificial Sequence
  dgRNA
  Gnptab
gagggcccaaagggc

SEQ ID NO: 79285 - DNA, 15 bp, Artificial Sequence
  dgRNA
  Gnptab
cggcgcacgcgcaga

SEQ ID NO: 79286 - DNA, 15 bp, Artificial Sequence
  dgRNA
  Ufsp2
gcgcgtccacgaaaa

SEQ ID NO: 79287 - DNA, 15 bp, Artificial Sequence
  dgRNA
  Ufsp2
acgaaaacggaagaa

SEQ ID NO: 79288 - DNA, 15 bp, Artificial Sequence
  dgRNA
  Ufsp2
ctgtttccccgccat

SEQ ID NO: 79289 - DNA, 15 bp, Artificial Sequence
  dgRNA
  Ufsp2
cgaatagtttccctg

SEQ ID NO: 79290 - DNA, 15 bp, Artificial Sequence
  dgRNA
  Samt2
acctcatcattgctc

SEQ ID NO: 79291 - DNA, 15 bp, Artificial Sequence
  dgRNA
  Samt2
tgatgaggttcaaat

SEQ ID NO: 79292 - DNA, 15 bp, Artificial Sequence
  dgRNA
  Samt2
atgatgaggttcaaa

SEQ ID NO: 79293 - DNA, 15 bp, Artificial Sequence
  dgRNA
  Myo1f
ggactttctctagtc

SEQ ID NO: 79294 - DNA, 15 bp, Artificial Sequence
  dgRNA
  Myo1f
ttgacctatcccttc

SEQ ID NO: 79295 - DNA, 15 bp, Artificial Sequence
  dgRNA
  Myo1f
tgacctatcccttca

SEQ ID NO: 79296 - DNA, 15 bp, Artificial Sequence
  dgRNA
  Myo1f
agggtaagctccaaa

SEQ ID NO: 79297 - DNA, 15 bp, Artificial Sequence
  dgRNA
  Zfc3h1
acagttaagactgca

SEQ ID NO: 79298 - DNA, 15 bp, Artificial Sequence
  dgRNA
  Zfc3h1
cacaagggcgaagcc

SEQ ID NO: 79299 - DNA, 15 bp, Artificial Sequence
  dgRNA
  Zfc3h1
gcaccgcggcggaca

SEQ ID NO: 79300 - DNA, 15 bp, Artificial Sequence
  dgRNA
  Zfc3h1
caccgcggcggacat

SEQ ID NO: 79301 - DNA, 15 bp, Artificial Sequence
  dgRNA
  Spry2
gcgcctgcctccact

SEQ ID NO: 79302 - DNA, 15 bp, Artificial Sequence
  dgRNA
  Spry2
cgcctgcctccactt

SEQ ID NO: 79303 - DNA, 15 bp, Artificial Sequence
  dgRNA
  Spry2
cgggcccccgggtct

SEQ ID NO: 79304 - DNA, 15 bp, Artificial Sequence
  dgRNA
  Spry2
cgggtcttggcgagc

SEQ ID NO: 79305 - DNA, 15 bp, Artificial Sequence
  dgRNA
  Hs6st3
tccgctcgtaggccc

SEQ ID NO: 79306 - DNA, 15 bp, Artificial Sequence
  dgRNA
  Hs6st3
cggctctgccaaccc

SEQ ID NO: 79307 - DNA, 15 bp, Artificial Sequence
  dgRNA
  Hs6st3
gccaaccccggagtg

SEQ ID NO: 79308 - DNA, 15 bp, Artificial Sequence
  dgRNA
  Hs6st3
aaccccggagtgcgg

SEQ ID NO: 79309 - DNA, 15 bp, Artificial Sequence
  dgRNA
  Slc37a1
ccaaccagtctgaag

SEQ ID NO: 79310 - DNA, 15 bp, Artificial Sequence
  dgRNA
  Slc37a1
caaccagtctgaaga

SEQ ID NO: 79311 - DNA, 15 bp, Artificial Sequence
  dgRNA
  Slc37a1
tcctcaccctcgccc

SEQ ID NO: 79312 - DNA, 15 bp, Artificial Sequence
  dgRNA
  Slc37a1
gttcatgcatcgggt

SEQ ID NO: 79313 - DNA, 15 bp, Artificial Sequence
  dgRNA
  Spg7
taaatacgtacagga

SEQ ID NO: 79314 - DNA, 15 bp, Artificial Sequence
  dgRNA
  Spg7
tacgtacaggaagga

SEQ ID NO: 79315 - DNA, 15 bp, Artificial Sequence
  dgRNA
  Spg7
acggaagtggccaac

SEQ ID NO: 79316 - DNA, 15 bp, Artificial Sequence
  dgRNA
  Spg7
ctggaaaccgcaact

SEQ ID NO: 79317 - DNA, 15 bp, Artificial Sequence
  dgRNA
  Hcn1
gtacaaatacgcgtc

SEQ ID NO: 79318 - DNA, 15 bp, Artificial Sequence
  dgRNA
  Hcn1
tacaaatacgcgtcc

SEQ ID NO: 79319 - DNA, 15 bp, Artificial Sequence
  dgRNA
  Hcn1
acaaatacgcgtccg

SEQ ID NO: 79320 - DNA, 15 bp, Artificial Sequence
  dgRNA
  Hcn1
aatacgcgtccgggg

SEQ ID NO: 79321 - DNA, 15 bp, Artificial Sequence
  dgRNA
  Chchd10
tctctccagaggtta

SEQ ID NO: 79322 - DNA, 15 bp, Artificial Sequence
  dgRNA
  Chchd10
aaaaccgagttccag

SEQ ID NO: 79323 - DNA, 15 bp, Artificial Sequence
  dgRNA
  Chchd10
cgagttccagaggac

SEQ ID NO: 79324 - DNA, 15 bp, Artificial Sequence
  dgRNA
  Chchd10
tcatgccataacctc

SEQ ID NO: 79325 - DNA, 15 bp, Artificial Sequence
  dgRNA
  S1pr2
cgtgacatcatgcca

SEQ ID NO: 79326 - DNA, 15 bp, Artificial Sequence
  dgRNA
  S1pr2
ggcagttctcacgag

SEQ ID NO: 79327 - DNA, 15 bp, Artificial Sequence
  dgRNA
  S1pr2
gcagttctcacgagt

SEQ ID NO: 79328 - DNA, 15 bp, Artificial Sequence
  dgRNA
  S1pr2
cagttctcacgagtg

SEQ ID NO: 79329 - DNA, 15 bp, Artificial Sequence
  dgRNA
  Dopey1
aaaatgatggttcgc

SEQ ID NO: 79330 - DNA, 15 bp, Artificial Sequence
  dgRNA
  Dopey1
cctccgccgtctctc

SEQ ID NO: 79331 - DNA, 15 bp, Artificial Sequence
  dgRNA
  Dopey1
ccggtcgcccgcacg

SEQ ID NO: 79332 - DNA, 15 bp, Artificial Sequence
  dgRNA
  Dopey1
cggtcgcccgcacga

SEQ ID NO: 79333 - DNA, 15 bp, Artificial Sequence
  dgRNA
  Eogt
gacttggacacttca

SEQ ID NO: 79334 - DNA, 15 bp, Artificial Sequence
  dgRNA
  Eogt
aatactgtagattcc

SEQ ID NO: 79335 - DNA, 15 bp, Artificial Sequence
  dgRNA
  Eogt
gtttacatatcactc

SEQ ID NO: 79336 - DNA, 15 bp, Artificial Sequence
  dgRNA
  Rcc2
gccgcgctgcgtgca

SEQ ID NO: 79337 - DNA, 15 bp, Artificial Sequence
  dgRNA
  Rcc2
ccgcgctgcgtgcaa

SEQ ID NO: 79338 - DNA, 15 bp, Artificial Sequence
  dgRNA
  Rcc2
tgcggagcgcgcaag

SEQ ID NO: 79339 - DNA, 15 bp, Artificial Sequence
  dgRNA
  Rcc2
ggagcgcgcaagcgg

SEQ ID NO: 79340 - DNA, 15 bp, Artificial Sequence
  dgRNA
  Slc4a1ap
tgcgagtcttgaaag

SEQ ID NO: 79341 - DNA, 15 bp, Artificial Sequence
  dgRNA
  Slc4a1ap
aacgtagagagcgag

SEQ ID NO: 79342 - DNA, 15 bp, Artificial Sequence
  dgRNA
  Slc4a1ap
gggtcggggtttccg

SEQ ID NO: 79343 - DNA, 15 bp, Artificial Sequence
  dgRNA
  Slc4a1ap
ggtcggggtttccga

SEQ ID NO: 79344 - DNA, 15 bp, Artificial Sequence
  dgRNA
  Cep295
accctgacagttgag

SEQ ID NO: 79345 - DNA, 15 bp, Artificial Sequence
  dgRNA
  Cep295
tgcgtgcgtgcacgt

SEQ ID NO: 79346 - DNA, 15 bp, Artificial Sequence
  dgRNA
  Cep295
tgcgtgcacgtgggc

SEQ ID NO: 79347 - DNA, 15 bp, Artificial Sequence
  dgRNA
  Cep295
gcgtgcacgtgggcg

SEQ ID NO: 79348 - DNA, 15 bp, Artificial Sequence
  dgRNA
  Krtap19-4
atgcaagaagagcga

SEQ ID NO: 79349 - DNA, 15 bp, Artificial Sequence
  dgRNA
  Krtap19-4
accacgtgttcttct

SEQ ID NO: 79350 - DNA, 15 bp, Artificial Sequence
  dgRNA
  Krtap19-4
tataagcctcccgtg

SEQ ID NO: 79351 - DNA, 15 bp, Artificial Sequence
  dgRNA
  Krtap19-4
tgtccactggcaagg

SEQ ID NO: 79352 - DNA, 15 bp, Artificial Sequence
  dgRNA
  Pabpc4
tcgaccagcagcgcc

SEQ ID NO: 79353 - DNA, 15 bp, Artificial Sequence
  dgRNA
  Pabpc4
cgaccagcagcgccc

SEQ ID NO: 79354 - DNA, 15 bp, Artificial Sequence
  dgRNA
  Pabpc4
gaccagcagcgcccg

SEQ ID NO: 79355 - DNA, 15 bp, Artificial Sequence
  dgRNA
  Pabpc4
cagcagcgcccgggg

SEQ ID NO: 79356 - DNA, 15 bp, Artificial Sequence
  dgRNA
  Hk2
ctcccgccgcctgct

SEQ ID NO: 79357 - DNA, 15 bp, Artificial Sequence
  dgRNA
  Hk2
tcccgccgcctgctt

SEQ ID NO: 79358 - DNA, 15 bp, Artificial Sequence
  dgRNA
  Hk2
cgcctgcttgggtgc

SEQ ID NO: 79359 - DNA, 15 bp, Artificial Sequence
  dgRNA
  Hk2
gagcagccgcgcccg

SEQ ID NO: 79360 - DNA, 15 bp, Artificial Sequence
  dgRNA
  Fasl
gctaatgtcctcaag

SEQ ID NO: 79361 - DNA, 15 bp, Artificial Sequence
  dgRNA
  Fasl
gctgagttggacctc

SEQ ID NO: 79362 - DNA, 15 bp, Artificial Sequence
  dgRNA
  Fasl
cacagagacgccaat

SEQ ID NO: 79363 - DNA, 15 bp, Artificial Sequence
  dgRNA
  Fasl
gtcgtcagaaatttc

SEQ ID NO: 79364 - DNA, 15 bp, Artificial Sequence
  dgRNA
  Ccnb1ip1
caccttgtgaataac

SEQ ID NO: 79365 - DNA, 15 bp, Artificial Sequence
  dgRNA
  Ccnb1ip1
attgacctgtaaaac

SEQ ID NO: 79366 - DNA, 15 bp, Artificial Sequence
  dgRNA
  Ccnb1ip1
aacctcgttgagtcg

SEQ ID NO: 79367 - DNA, 15 bp, Artificial Sequence
  dgRNA
  Ccnb1ip1
atgatgggtagcgct

SEQ ID NO: 79368 - DNA, 15 bp, Artificial Sequence
  dgRNA
  Spata20
gcagtgcaaccgccc

SEQ ID NO: 79369 - DNA, 15 bp, Artificial Sequence
  dgRNA
  Spata20
cagtgcaaccgccca

SEQ ID NO: 79370 - DNA, 15 bp, Artificial Sequence
  dgRNA
  Spata20
tgcaaccgcccaggg

SEQ ID NO: 79371 - DNA, 15 bp, Artificial Sequence
  dgRNA
  Spata20
caaccgcccagggag

SEQ ID NO: 79372 - DNA, 15 bp, Artificial Sequence
  dgRNA
  Ttc30b
ccgatcccagagaaa

SEQ ID NO: 79373 - DNA, 15 bp, Artificial Sequence
  dgRNA
  Ttc30b
tgtaaaacgtcaaag

SEQ ID NO: 79374 - DNA, 15 bp, Artificial Sequence
  dgRNA
  Ttc30b
gatgcagggcgataa

SEQ ID NO: 79375 - DNA, 15 bp, Artificial Sequence
  dgRNA
  Ttc30b
taacggaagcgatgt

SEQ ID NO: 79376 - DNA, 15 bp, Artificial Sequence
  dgRNA
  Fam111a
cgggcttccttgact

SEQ ID NO: 79377 - DNA, 15 bp, Artificial Sequence
  dgRNA
  Fam111a
cggcccttagagacc

SEQ ID NO: 79378 - DNA, 15 bp, Artificial Sequence
  dgRNA
  Fam111a
ggcccttagagacca

SEQ ID NO: 79379 - DNA, 15 bp, Artificial Sequence
  dgRNA
  Fam111a
acactgcgcttgctc

SEQ ID NO: 79380 - DNA, 15 bp, Artificial Sequence
  dgRNA
  Nt5dc3
tattctttactcagc

SEQ ID NO: 79381 - DNA, 15 bp, Artificial Sequence
  dgRNA
  Nt5dc3
ttctttactcagccg

SEQ ID NO: 79382 - DNA, 15 bp, Artificial Sequence
  dgRNA
  Nt5dc3
ggctccgccccaccg

SEQ ID NO: 79383 - DNA, 15 bp, Artificial Sequence
  dgRNA
  Nt5dc3
tctcgattgcgtcag

SEQ ID NO: 79384 - DNA, 15 bp, Artificial Sequence
  dgRNA
  Zfp53
aacactatgtgacag

SEQ ID NO: 79385 - DNA, 15 bp, Artificial Sequence
  dgRNA
  Zfp53
acactatgtgacagt

SEQ ID NO: 79386 - DNA, 15 bp, Artificial Sequence
  dgRNA
  Zfp53
actgtcacatagtgt

SEQ ID NO: 79387 - DNA, 15 bp, Artificial Sequence
  dgRNA
  Gabrr2
ctggcgtttgtgtca

SEQ ID NO: 79388 - DNA, 15 bp, Artificial Sequence
  dgRNA
  Gabrr2
gcatcagtatcagtt

SEQ ID NO: 79389 - DNA, 15 bp, Artificial Sequence
  dgRNA
  Gabrr2
tcagtatcagttagg

SEQ ID NO: 79390 - DNA, 15 bp, Artificial Sequence
  dgRNA
  Gabrr2
atcagttaggaggtt

SEQ ID NO: 79391 - DNA, 15 bp, Artificial Sequence
  dgRNA
  Syt3
ccttctagttccctc

SEQ ID NO: 79392 - DNA, 15 bp, Artificial Sequence
  dgRNA
  Syt3
tctagttccctcagg

SEQ ID NO: 79393 - DNA, 15 bp, Artificial Sequence
  dgRNA
  Syt3
ggtggcctctcaact

SEQ ID NO: 79394 - DNA, 15 bp, Artificial Sequence
  dgRNA
  Syt3
gggaggtgcacacta

SEQ ID NO: 79395 - DNA, 15 bp, Artificial Sequence
  dgRNA
  Jmjd7
tcctccccggctgta

SEQ ID NO: 79396 - DNA, 15 bp, Artificial Sequence
  dgRNA
  Jmjd7
cctccccggctgtac

SEQ ID NO: 79397 - DNA, 15 bp, Artificial Sequence
  dgRNA
  Jmjd7
ctccccggctgtacg

SEQ ID NO: 79398 - DNA, 15 bp, Artificial Sequence
  dgRNA
  Jmjd7
cccggctgtacgggg

SEQ ID NO: 79399 - DNA, 15 bp, Artificial Sequence
  dgRNA
  Smarca2
ccccccgcgcgctcc

SEQ ID NO: 79400 - DNA, 15 bp, Artificial Sequence
  dgRNA
  Smarca2
ccggagtcgctgagc

SEQ ID NO: 79401 - DNA, 15 bp, Artificial Sequence
  dgRNA
  Smarca2
cggagtcgctgagca

SEQ ID NO: 79402 - DNA, 15 bp, Artificial Sequence
  dgRNA
  Smarca2
agcagggcgagtgac

SEQ ID NO: 79403 - DNA, 15 bp, Artificial Sequence
  dgRNA
  Lrit2
cacaacttctcgaca

SEQ ID NO: 79404 - DNA, 15 bp, Artificial Sequence
  dgRNA
  Lrit2
ggctgtaacagacct

SEQ ID NO: 79405 - DNA, 15 bp, Artificial Sequence
  dgRNA
  Lrit2
gctgtaacagacctc

SEQ ID NO: 79406 - DNA, 15 bp, Artificial Sequence
  dgRNA
  Lrit2
tggattaccaataat

SEQ ID NO: 79407 - DNA, 15 bp, Artificial Sequence
  dgRNA
  Ccdc40
accctgatacccacc

SEQ ID NO: 79408 - DNA, 15 bp, Artificial Sequence
  dgRNA
  Ccdc40
ccctgatacccaccc

SEQ ID NO: 79409 - DNA, 15 bp, Artificial Sequence
  dgRNA
  Ccdc40
ccgggtcccgccgcg

SEQ ID NO: 79410 - DNA, 15 bp, Artificial Sequence
  dgRNA
  Ccdc40
cgggtcccgccgcga

SEQ ID NO: 79411 - DNA, 15 bp, Artificial Sequence
  dgRNA
  Ncs1
ggaatggatcggcgg

SEQ ID NO: 79412 - DNA, 15 bp, Artificial Sequence
  dgRNA
  Ncs1
gaatggatcggcgga

SEQ ID NO: 79413 - DNA, 15 bp, Artificial Sequence
  dgRNA
  Ncs1
aatggatcggcggag

SEQ ID NO: 79414 - DNA, 15 bp, Artificial Sequence
  dgRNA
  Ncs1
atggatcggcggagg

SEQ ID NO: 79415 - DNA, 15 bp, Artificial Sequence
  dgRNA
  Snrnp70
gcgcagtacgacagc

SEQ ID NO: 79416 - DNA, 15 bp, Artificial Sequence
  dgRNA
  Snrnp70
cgcagtacgacagcc

SEQ ID NO: 79417 - DNA, 15 bp, Artificial Sequence
  dgRNA
  Snrnp70
acgacagccgggccg

SEQ ID NO: 79418 - DNA, 15 bp, Artificial Sequence
  dgRNA
  Snrnp70
catgcgcagtgcccc

SEQ ID NO: 79419 - DNA, 15 bp, Artificial Sequence
  dgRNA
  Bub1
gtcagcacctagcat

SEQ ID NO: 79420 - DNA, 15 bp, Artificial Sequence
  dgRNA
  Bub1
aaagaactgcgggct

SEQ ID NO: 79421 - DNA, 15 bp, Artificial Sequence
  dgRNA
  Bub1
aagaactgcgggcta

SEQ ID NO: 79422 - DNA, 15 bp, Artificial Sequence
  dgRNA
  Bub1
actgcgggctaggga

SEQ ID NO: 79423 - DNA, 15 bp, Artificial Sequence
  dgRNA
  Fbxo24
tgagctactgataga

SEQ ID NO: 79424 - DNA, 15 bp, Artificial Sequence
  dgRNA
  Fbxo24
ggatacatgctttat

SEQ ID NO: 79425 - DNA, 15 bp, Artificial Sequence
  dgRNA
  Fbxo24
tgccagagggctcat

SEQ ID NO: 79426 - DNA, 15 bp, Artificial Sequence
  dgRNA
  Fbxo24
gttatggctgccaga

SEQ ID NO: 79427 - DNA, 15 bp, Artificial Sequence
  dgRNA
  Nudt15
cattcgggtgccgta

SEQ ID NO: 79428 - DNA, 15 bp, Artificial Sequence
  dgRNA
  Nudt15
attcgggtgccgtat

SEQ ID NO: 79429 - DNA, 15 bp, Artificial Sequence
  dgRNA
  Nudt15
cgggtgccgtatggg

SEQ ID NO: 79430 - DNA, 15 bp, Artificial Sequence
  dgRNA
  Nudt15
gtatgggtggccaac

SEQ ID NO: 79431 - DNA, 15 bp, Artificial Sequence
  dgRNA
  Cfap74
cccagacgattctcc

SEQ ID NO: 79432 - DNA, 15 bp, Artificial Sequence
  dgRNA
  Cfap74
gacgagcatcgcgga

SEQ ID NO: 79433 - DNA, 15 bp, Artificial Sequence
  dgRNA
  Cfap74
ggacgagcatcgcgg

SEQ ID NO: 79434 - DNA, 15 bp, Artificial Sequence
  dgRNA
  Cfap74
gtgggacgagcatcg

SEQ ID NO: 79435 - DNA, 15 bp, Artificial Sequence
  dgRNA
  Iars2
tacagacttccaagc

SEQ ID NO: 79436 - DNA, 15 bp, Artificial Sequence
  dgRNA
  Iars2
tcatgaggtctagta

SEQ ID NO: 79437 - DNA, 15 bp, Artificial Sequence
  dgRNA
  Iars2
ttcatgaggtctagt

SEQ ID NO: 79438 - DNA, 15 bp, Artificial Sequence
  dgRNA
  Iars2
cggggttttccggct

SEQ ID NO: 79439 - DNA, 15 bp, Artificial Sequence
  dgRNA
  Ttc29
accagatcctcttgc

SEQ ID NO: 79440 - DNA, 15 bp, Artificial Sequence
  dgRNA
  Ttc29
cgcccactcactaac

SEQ ID NO: 79441 - DNA, 15 bp, Artificial Sequence
  dgRNA
  Ttc29
aactacgcctccatc

SEQ ID NO: 79442 - DNA, 15 bp, Artificial Sequence
  dgRNA
  Ttc29
ggcgtggcctgcaag

SEQ ID NO: 79443 - DNA, 15 bp, Artificial Sequence
  dgRNA
  Sord
taaacttgctgttcg

SEQ ID NO: 79444 - DNA, 15 bp, Artificial Sequence
  dgRNA
  Sord
aaacttgctgttcga

SEQ ID NO: 79445 - DNA, 15 bp, Artificial Sequence
  dgRNA
  Sord
aacttgctgttcgag

SEQ ID NO: 79446 - DNA, 15 bp, Artificial Sequence
  dgRNA
  Sord
tcgaggggtgctagc

SEQ ID NO: 79447 - DNA, 15 bp, Artificial Sequence
  dgRNA
  Olfr1389
attgggtagtaaaat

SEQ ID NO: 79448 - DNA, 15 bp, Artificial Sequence
  dgRNA
  Olfr1389
ttgggtagtaaaata

SEQ ID NO: 79449 - DNA, 15 bp, Artificial Sequence
  dgRNA
  Olfr1389
tgttatgcatgattc

SEQ ID NO: 79450 - DNA, 15 bp, Artificial Sequence
  dgRNA
  Olfr1389
gtttagggaaccgtg

SEQ ID NO: 79451 - DNA, 15 bp, Artificial Sequence
  dgRNA
  Cand2
aggggcgtggccggt

SEQ ID NO: 79452 - DNA, 15 bp, Artificial Sequence
  dgRNA
  Padi1
aacctggctgatttc

SEQ ID NO: 79453 - DNA, 15 bp, Artificial Sequence
  dgRNA
  Padi1
catgacttaggtgac

SEQ ID NO: 79454 - DNA, 15 bp, Artificial Sequence
  dgRNA
  Padi1
atgacttaggtgact

SEQ ID NO: 79455 - DNA, 15 bp, Artificial Sequence
  dgRNA
  Padi1
gaaatcagccaggtt

SEQ ID NO: 79456 - DNA, 15 bp, Artificial Sequence
  dgRNA
  Ly9
gcactcacatacttc

SEQ ID NO: 79457 - DNA, 15 bp, Artificial Sequence
  dgRNA
  Ly9
gtggtgcacggtttg

SEQ ID NO: 79458 - DNA, 15 bp, Artificial Sequence
  dgRNA
  Ly9
cgcatgcgtggtttg

SEQ ID NO: 79459 - DNA, 15 bp, Artificial Sequence
  dgRNA
  Sprr4
gtagctcatttgctg

SEQ ID NO: 79460 - DNA, 15 bp, Artificial Sequence
  dgRNA
  Sprr4
ttgcactagcgccca

SEQ ID NO: 79461 - DNA, 15 bp, Artificial Sequence
  dgRNA
  Hbb-bh1
gtctctccgaggcag

SEQ ID NO: 79462 - DNA, 15 bp, Artificial Sequence
  dgRNA
  Hbb-bh1
tctctccgaggcagg

SEQ ID NO: 79463 - DNA, 15 bp, Artificial Sequence
  dgRNA
  Hbb-bh1
tagaacttaccccac

SEQ ID NO: 79464 - DNA, 15 bp, Artificial Sequence
  dgRNA
  Hbb-bh1
ggggagcaaggtcca

SEQ ID NO: 79465 - DNA, 15 bp, Artificial Sequence
  dgRNA
  Ap2a1
aactcccccgtctct

SEQ ID NO: 79466 - DNA, 15 bp, Artificial Sequence
  dgRNA
  Ap2a1
actcccccgtctcta

SEQ ID NO: 79467 - DNA, 15 bp, Artificial Sequence
  dgRNA
  Ap2a1
tcgatgacacactct

SEQ ID NO: 79468 - DNA, 15 bp, Artificial Sequence
  dgRNA
  Ap2a1
ttcgatgacacactc

SEQ ID NO: 79469 - DNA, 15 bp, Artificial Sequence
  dgRNA
  Pom121
ctcccgcgttctgag

SEQ ID NO: 79470 - DNA, 15 bp, Artificial Sequence
  dgRNA
  Pom121
gccgtgctccgcacg

SEQ ID NO: 79471 - DNA, 15 bp, Artificial Sequence
  dgRNA
  Pom121
gtgctccgcacgcgg

SEQ ID NO: 79472 - DNA, 15 bp, Artificial Sequence
  dgRNA
  Pom121
ctccgcacgcggcgg

SEQ ID NO: 79473 - DNA, 15 bp, Artificial Sequence
  dgRNA
  Agtr1b
gagcctgtatcaagt

SEQ ID NO: 79474 - DNA, 15 bp, Artificial Sequence
  dgRNA
  Agtr1b
aatctgtcaagggag

SEQ ID NO: 79475 - DNA, 15 bp, Artificial Sequence
  dgRNA
  Agtr1b
tcaggagggtcttta

SEQ ID NO: 79476 - DNA, 15 bp, Artificial Sequence
  dgRNA
  Agtr1b
gagggtctttaaggc

SEQ ID NO: 79477 - DNA, 15 bp, Artificial Sequence
  dgRNA
  Dnaja3
cggatgcctcgcctc

SEQ ID NO: 79478 - DNA, 15 bp, Artificial Sequence
  dgRNA
  Dnaja3
tccggaagacgcgac

SEQ ID NO: 79479 - DNA, 15 bp, Artificial Sequence
  dgRNA
  Dnaja3
aagacgcgaccggcg

SEQ ID NO: 79480 - DNA, 15 bp, Artificial Sequence
  dgRNA
  Dnaja3
acgcgaccggcgagg

SEQ ID NO: 79481 - DNA, 15 bp, Artificial Sequence
  dgRNA
  Tyro3
atgctatgccgagag

SEQ ID NO: 79482 - DNA, 15 bp, Artificial Sequence
  dgRNA
  Tyro3
agagaggcgctgagt

SEQ ID NO: 79483 - DNA, 15 bp, Artificial Sequence
  dgRNA
  Tyro3
ctagggtatgtgagc

SEQ ID NO: 79484 - DNA, 15 bp, Artificial Sequence
  dgRNA
  Tyro3
ctctcggcatagcat

SEQ ID NO: 79485 - DNA, 15 bp, Artificial Sequence
  dgRNA
  Olfr777
gtaaattactactcc

SEQ ID NO: 79486 - DNA, 15 bp, Artificial Sequence
  dgRNA
  Olfr777
attgcagactggata

SEQ ID NO: 79487 - DNA, 15 bp, Artificial Sequence
  dgRNA
  Olfr777
ttgcagactggatag

SEQ ID NO: 79488 - DNA, 15 bp, Artificial Sequence
  dgRNA
  Olfr777
ggttggcaaacataa

SEQ ID NO: 79489 - DNA, 15 bp, Artificial Sequence
  dgRNA
  Nmral1
gccaaagcccattct

SEQ ID NO: 79490 - DNA, 15 bp, Artificial Sequence
  dgRNA
  Nmral1
tccgagaatgggctt

SEQ ID NO: 79491 - DNA, 15 bp, Artificial Sequence
  dgRNA
  Ttc38
caccaatgagagatc

SEQ ID NO: 79492 - DNA, 15 bp, Artificial Sequence
  dgRNA
  Ttc38
gagatccggatagcg

SEQ ID NO: 79493 - DNA, 15 bp, Artificial Sequence
  dgRNA
  Ttc38
atctctccgacccac

SEQ ID NO: 79494 - DNA, 15 bp, Artificial Sequence
  dgRNA
  Ttc38
gcgcagctcatctca

SEQ ID NO: 79495 - DNA, 15 bp, Artificial Sequence
  dgRNA
  Lrrc3b
ctcccctccttattc

SEQ ID NO: 79496 - DNA, 15 bp, Artificial Sequence
  dgRNA
  Lrrc3b
ggatctccagctagg

SEQ ID NO: 79497 - DNA, 15 bp, Artificial Sequence
  dgRNA
  Lrrc3b
agagcagtgccagtt

SEQ ID NO: 79498 - DNA, 15 bp, Artificial Sequence
  dgRNA
  Lrrc3b
tggagatcctgaata

SEQ ID NO: 79499 - DNA, 15 bp, Artificial Sequence
  dgRNA
  Zranb3
gagaatgaagtcgca

SEQ ID NO: 79500 - DNA, 15 bp, Artificial Sequence
  dgRNA
  Zranb3
cgcaaggttctagtc

SEQ ID NO: 79501 - DNA, 15 bp, Artificial Sequence
  dgRNA
  Zranb3
ttttcgcatcgctaa

SEQ ID NO: 79502 - DNA, 15 bp, Artificial Sequence
  dgRNA
  Zranb3
cgcatcgctaaagga

SEQ ID NO: 79503 - DNA, 15 bp, Artificial Sequence
  dgRNA
  6330408A02Rik
atttcgcgcgcactt

SEQ ID NO: 79504 - DNA, 15 bp, Artificial Sequence
  dgRNA
  6330408A02Rik
tcgcgcgcactttgg

SEQ ID NO: 79505 - DNA, 15 bp, Artificial Sequence
  dgRNA
  6330408A02Rik
cgcgcgcactttggc

SEQ ID NO: 79506 - DNA, 15 bp, Artificial Sequence
  dgRNA
  6330408A02Rik
gcgcactttggcggg

SEQ ID NO: 79507 - DNA, 15 bp, Artificial Sequence
  dgRNA
  Naf1
gaacttggcggactt

SEQ ID NO: 79508 - DNA, 15 bp, Artificial Sequence
  dgRNA
  Naf1
ggacttaggaccgcg

SEQ ID NO: 79509 - DNA, 15 bp, Artificial Sequence
  dgRNA
  Naf1
agtttcctccatagt

SEQ ID NO: 79510 - DNA, 15 bp, Artificial Sequence
  dgRNA
  Naf1
gaatccttcagcccc

SEQ ID NO: 79511 - DNA, 15 bp, Artificial Sequence
  dgRNA
  Tesk2
ccgagcgttgctgat

SEQ ID NO: 79512 - DNA, 15 bp, Artificial Sequence
  dgRNA
  Tesk2
caccctcgtaccacg

SEQ ID NO: 79513 - DNA, 15 bp, Artificial Sequence
  dgRNA
  Tesk2
attcctaacgttaat

SEQ ID NO: 79514 - DNA, 15 bp, Artificial Sequence
  dgRNA
  Tesk2
ttcctaacgttaatt

SEQ ID NO: 79515 - DNA, 15 bp, Artificial Sequence
  dgRNA
  Hrct1
ttaatctccatacag

SEQ ID NO: 79516 - DNA, 15 bp, Artificial Sequence
  dgRNA
  Hrct1
catacagtggttcct

SEQ ID NO: 79517 - DNA, 15 bp, Artificial Sequence
  dgRNA
  Hrct1
tcatatccctgattc

SEQ ID NO: 79518 - DNA, 15 bp, Artificial Sequence
  dgRNA
  Hrct1
ctaggaaccactgta

SEQ ID NO: 79519 - DNA, 15 bp, Artificial Sequence
  dgRNA
  Rab30
gctcgccgcagctcc

SEQ ID NO: 79520 - DNA, 15 bp, Artificial Sequence
  dgRNA
  Rab30
agggctccaacatgg

SEQ ID NO: 79521 - DNA, 15 bp, Artificial Sequence
  dgRNA
  Rab30
ctccaacatggcggc

SEQ ID NO: 79522 - DNA, 15 bp, Artificial Sequence
  dgRNA
  Rab30
cctctacgtcgctcc

SEQ ID NO: 79523 - DNA, 15 bp, Artificial Sequence
  dgRNA
  Atp2c1
tcatatcgctatcgc

SEQ ID NO: 79524 - DNA, 15 bp, Artificial Sequence
  dgRNA
  Atp2c1
catatcgctatcgct

SEQ ID NO: 79525 - DNA, 15 bp, Artificial Sequence
  dgRNA
  Atp2c1
tgggcattgcagttc

SEQ ID NO: 79526 - DNA, 15 bp, Artificial Sequence
  dgRNA
  Atp2c1
gaacttccactcaaa

SEQ ID NO: 79527 - DNA, 15 bp, Artificial Sequence
  dgRNA
  Arhgef38
ctaactcagtgcagc

SEQ ID NO: 79528 - DNA, 15 bp, Artificial Sequence
  dgRNA
  Arhgef38
ggtctctcgggtaac

SEQ ID NO: 79529 - DNA, 15 bp, Artificial Sequence
  dgRNA
  Arhgef38
ctctcgggtaacagg

SEQ ID NO: 79530 - DNA, 15 bp, Artificial Sequence
  dgRNA
  Arhgef38
ggcaacttcccctgt

SEQ ID NO: 79531 - DNA, 15 bp, Artificial Sequence
  dgRNA
  Spint1
gcctccagggcacgc

SEQ ID NO: 79532 - DNA, 15 bp, Artificial Sequence
  dgRNA
  Spint1
cctcacccacgccgc

SEQ ID NO: 79533 - DNA, 15 bp, Artificial Sequence
  dgRNA
  Spint1
ctcacccacgccgct

SEQ ID NO: 79534 - DNA, 15 bp, Artificial Sequence
  dgRNA
  Spint1
ggcgttcggaaacca

SEQ ID NO: 79535 - DNA, 15 bp, Artificial Sequence
  dgRNA
  Bet1
ctgtcgctgcccttc

SEQ ID NO: 79536 - DNA, 15 bp, Artificial Sequence
  dgRNA
  Bet1
tagtaatcgcatttc

SEQ ID NO: 79537 - DNA, 15 bp, Artificial Sequence
  dgRNA
  Bet1
ctagtcctgttattc

SEQ ID NO: 79538 - DNA, 15 bp, Artificial Sequence
  dgRNA
  Bet1
gcggggcttccggaa

SEQ ID NO: 79539 - DNA, 15 bp, Artificial Sequence
  dgRNA
  Rab2a
gcgactgaacctagc

SEQ ID NO: 79540 - DNA, 15 bp, Artificial Sequence
  dgRNA
  Rab2a
cgactccccgagccc

SEQ ID NO: 79541 - DNA, 15 bp, Artificial Sequence
  dgRNA
  Rab2a
gagccccggcctggt

SEQ ID NO: 79542 - DNA, 15 bp, Artificial Sequence
  dgRNA
  Rab2a
ccccggcctggtagg

SEQ ID NO: 79543 - DNA, 15 bp, Artificial Sequence
  dgRNA
  Fcer1a
tgcctataagattct

SEQ ID NO: 79544 - DNA, 15 bp, Artificial Sequence
  dgRNA
  Fcer1a
taaaattgcccaatt

SEQ ID NO: 79545 - DNA, 15 bp, Artificial Sequence
  dgRNA
  Fcer1a
tagaatcttataggc

SEQ ID NO: 79546 - DNA, 15 bp, Artificial Sequence
  dgRNA
  Fcer1a
cacctagaatcttat

SEQ ID NO: 79547 - DNA, 15 bp, Artificial Sequence
  dgRNA
  Spin2c
cccagcttagaacca

SEQ ID NO: 79548 - DNA, 15 bp, Artificial Sequence
  dgRNA
  Spin2c
cttagaaccacggtg

SEQ ID NO: 79549 - DNA, 15 bp, Artificial Sequence
  dgRNA
  Spin2c
accacggtgtggagt

SEQ ID NO: 79550 - DNA, 15 bp, Artificial Sequence
  dgRNA
  Spin2c
ctgttgaaccgtgtt

SEQ ID NO: 79551 - DNA, 15 bp, Artificial Sequence
  dgRNA
  S100g
tccagattttaccct

SEQ ID NO: 79552 - DNA, 15 bp, Artificial Sequence
  dgRNA
  S100g
atttcacaatcaggg

SEQ ID NO: 79553 - DNA, 15 bp, Artificial Sequence
  dgRNA
  S100g
cccaagggtaaaatc

SEQ ID NO: 79554 - DNA, 15 bp, Artificial Sequence
  dgRNA
  S100g
taagactctcaatta

SEQ ID NO: 79555 - DNA, 15 bp, Artificial Sequence
  dgRNA
  Grxcr1
ttctttcgctgtcac

SEQ ID NO: 79556 - DNA, 15 bp, Artificial Sequence
  dgRNA
  Grxcr1
tttcgctgtcacagg

SEQ ID NO: 79557 - DNA, 15 bp, Artificial Sequence
  dgRNA
  Grxcr1
gagggctaccatctc

SEQ ID NO: 79558 - DNA, 15 bp, Artificial Sequence
  dgRNA
  Grxcr1
attaaacgtccatgg

SEQ ID NO: 79559 - DNA, 15 bp, Artificial Sequence
  dgRNA
  Gpr146
tacaaactttaatgg

SEQ ID NO: 79560 - DNA, 15 bp, Artificial Sequence
  dgRNA
  Gpr146
cgccctccagcatta

SEQ ID NO: 79561 - DNA, 15 bp, Artificial Sequence
  dgRNA
  Gpr146
cctccagcattaagg

SEQ ID NO: 79562 - DNA, 15 bp, Artificial Sequence
  dgRNA
  Gpr146
cagcattaaggcggc

SEQ ID NO: 79563 - DNA, 15 bp, Artificial Sequence
  dgRNA
  Tmem33
catttccgtgccaat

SEQ ID NO: 79564 - DNA, 15 bp, Artificial Sequence
  dgRNA
  Tmem33
tgccaattggctcgt

SEQ ID NO: 79565 - DNA, 15 bp, Artificial Sequence
  dgRNA
  Tmem33
gccaattggctcgta

SEQ ID NO: 79566 - DNA, 15 bp, Artificial Sequence
  dgRNA
  Tmem33
attggctcgtaggga

SEQ ID NO: 79567 - DNA, 15 bp, Artificial Sequence
  dgRNA
  Slc6a12
ttgaaagcctacagc

SEQ ID NO: 79568 - DNA, 15 bp, Artificial Sequence
  dgRNA
  Slc6a12
aatcttgtcctcggc

SEQ ID NO: 79569 - DNA, 15 bp, Artificial Sequence
  dgRNA
  Slc6a12
gtaggctttcaaggg

SEQ ID NO: 79570 - DNA, 15 bp, Artificial Sequence
  dgRNA
  Slc6a12
gctgtaggctttcaa

SEQ ID NO: 79571 - DNA, 15 bp, Artificial Sequence
  dgRNA
  Slc25a38
aaagcgccgagcaga

SEQ ID NO: 79572 - DNA, 15 bp, Artificial Sequence
  dgRNA
  Slc25a38
ttaagtgcagccacc

SEQ ID NO: 79573 - DNA, 15 bp, Artificial Sequence
  dgRNA
  Slc25a38
atgagatctcgtcgc

SEQ ID NO: 79574 - DNA, 15 bp, Artificial Sequence
  dgRNA
  Slc25a38
gatacgctatgtcac

SEQ ID NO: 79575 - DNA, 15 bp, Artificial Sequence
  dgRNA
  Cdk16
ccctggcgccgttcc

SEQ ID NO: 79576 - DNA, 15 bp, Artificial Sequence
  dgRNA
  Cdk16
cctggcgccgttcca

SEQ ID NO: 79577 - DNA, 15 bp, Artificial Sequence
  dgRNA
  Cdk16
cgccacattccctgc

SEQ ID NO: 79578 - DNA, 15 bp, Artificial Sequence
  dgRNA
  Cdk16
gccacattccctgct

SEQ ID NO: 79579 - DNA, 15 bp, Artificial Sequence
  dgRNA
  Usp19
agtgaccactcccta

SEQ ID NO: 79580 - DNA, 15 bp, Artificial Sequence
  dgRNA
  Usp19
cacgccatcagctgt

SEQ ID NO: 79581 - DNA, 15 bp, Artificial Sequence
  dgRNA
  Usp19
ctagggagtggtcac

SEQ ID NO: 79582 - DNA, 15 bp, Artificial Sequence
  dgRNA
  Usp19
caaggctaggcccta

SEQ ID NO: 79583 - DNA, 15 bp, Artificial Sequence
  dgRNA
  Phtf1
gtctcgtccccccaa

SEQ ID NO: 79584 - DNA, 15 bp, Artificial Sequence
  dgRNA
  Aldh1a3
ggccgcagcctaggt

SEQ ID NO: 79585 - DNA, 15 bp, Artificial Sequence
  dgRNA
  Aldh1a3
cagcctaggtcggtc

SEQ ID NO: 79586 - DNA, 15 bp, Artificial Sequence
  dgRNA
  Aldh1a3
agcctaggtcggtct

SEQ ID NO: 79587 - DNA, 15 bp, Artificial Sequence
  dgRNA
  Aldh1a3
ggaccgtcccgctcc

SEQ ID NO: 79588 - DNA, 15 bp, Artificial Sequence
  dgRNA
  Dapl1
gcttaatgatgagcc

SEQ ID NO: 79589 - DNA, 15 bp, Artificial Sequence
  dgRNA
  Dapl1
agcaatgccctcaag

SEQ ID NO: 79590 - DNA, 15 bp, Artificial Sequence
  dgRNA
  Dapl1
caggtagatgtttac

SEQ ID NO: 79591 - DNA, 15 bp, Artificial Sequence
  dgRNA
  Dapl1
ttctttcgttagcct

SEQ ID NO: 79592 - DNA, 15 bp, Artificial Sequence
  dgRNA
  Pkp3
gaacccacgttcctg

SEQ ID NO: 79593 - DNA, 15 bp, Artificial Sequence
  dgRNA
  Pkp3
aggccaggcgacttg

SEQ ID NO: 79594 - DNA, 15 bp, Artificial Sequence
  dgRNA
  Pkp3
gacttgaggacacgc

SEQ ID NO: 79595 - DNA, 15 bp, Artificial Sequence
  dgRNA
  Pkp3
acttgaggacacgca

SEQ ID NO: 79596 - DNA, 15 bp, Artificial Sequence
  dgRNA
  Mllt11
ttacctgcggctccc

SEQ ID NO: 79597 - DNA, 15 bp, Artificial Sequence
  dgRNA
  Mllt11
ccggcgtccccactg

SEQ ID NO: 79598 - DNA, 15 bp, Artificial Sequence
  dgRNA
  Mllt11
cggcgtccccactgc

SEQ ID NO: 79599 - DNA, 15 bp, Artificial Sequence
  dgRNA
  Mllt11
cgtccccactgcggg

SEQ ID NO: 79600 - DNA, 15 bp, Artificial Sequence
  dgRNA
  Echdc1
cgggaagagggtctc

SEQ ID NO: 79601 - DNA, 15 bp, Artificial Sequence
  dgRNA
  Echdc1
gcgcaagtcagagcc

SEQ ID NO: 79602 - DNA, 15 bp, Artificial Sequence
  dgRNA
  Echdc1
cgcaagtcagagcca

SEQ ID NO: 79603 - DNA, 15 bp, Artificial Sequence
  dgRNA
  Echdc1
tgcgggccggcggta

SEQ ID NO: 79604 - DNA, 15 bp, Artificial Sequence
  dgRNA
  Nxt2
gcgagcatgagcgag

SEQ ID NO: 79605 - DNA, 15 bp, Artificial Sequence
  dgRNA
  Nxt2
agcgagtggcgaatc

SEQ ID NO: 79606 - DNA, 15 bp, Artificial Sequence
  dgRNA
  Nxt2
agcccgccagcccct

SEQ ID NO: 79607 - DNA, 15 bp, Artificial Sequence
  dgRNA
  Nxt2
gcccgccagcccctg

SEQ ID NO: 79608 - DNA, 15 bp, Artificial Sequence
  dgRNA
  Olfr181
attgggtatttctgc

SEQ ID NO: 79609 - DNA, 15 bp, Artificial Sequence
  dgRNA
  Olfr181
ctaaagggagttcat

SEQ ID NO: 79610 - DNA, 15 bp, Artificial Sequence
  dgRNA
  Olfr181
gttacaatagcttca

SEQ ID NO: 79611 - DNA, 15 bp, Artificial Sequence
  dgRNA
  Olfr181
agttacaatagcttc

SEQ ID NO: 79612 - DNA, 15 bp, Artificial Sequence
  dgRNA
  Sergef
gctttggttgagtcc

SEQ ID NO: 79613 - DNA, 15 bp, Artificial Sequence
  dgRNA
  Sergef
gagtcccggcgctct

SEQ ID NO: 79614 - DNA, 15 bp, Artificial Sequence
  dgRNA
  Sergef
agtcccggcgctcta

SEQ ID NO: 79615 - DNA, 15 bp, Artificial Sequence
  dgRNA
  Sergef
ccggcgctctagggc

SEQ ID NO: 79616 - DNA, 15 bp, Artificial Sequence
  dgRNA
  Aqp1
gcatccatcgcagcg

SEQ ID NO: 79617 - DNA, 15 bp, Artificial Sequence
  dgRNA
  Aqp1
tccatcgcagcgagg

SEQ ID NO: 79618 - DNA, 15 bp, Artificial Sequence
  dgRNA
  Aqp1
gcgaggaggctcgtg

SEQ ID NO: 79619 - DNA, 15 bp, Artificial Sequence
  dgRNA
  Aqp1
aggctcgtgtggtgt

SEQ ID NO: 79620 - DNA, 15 bp, Artificial Sequence
  dgRNA
  Echdc3
ctgtgacctacaccc

SEQ ID NO: 79621 - DNA, 15 bp, Artificial Sequence
  dgRNA
  Echdc3
tgtgacctacaccca

SEQ ID NO: 79622 - DNA, 15 bp, Artificial Sequence
  dgRNA
  Echdc3
acctacacccagggc

SEQ ID NO: 79623 - DNA, 15 bp, Artificial Sequence
  dgRNA
  Echdc3
actagtttcgcagcc

SEQ ID NO: 79624 - DNA, 15 bp, Artificial Sequence
  dgRNA
  Ly6i
aacatgttggcctaa

SEQ ID NO: 79625 - DNA, 15 bp, Artificial Sequence
  dgRNA
  Ly6i
aagagaccatggtac

SEQ ID NO: 79626 - DNA, 15 bp, Artificial Sequence
  dgRNA
  Rasa3
tacagacccgaccaa

SEQ ID NO: 79627 - DNA, 15 bp, Artificial Sequence
  dgRNA
  Rasa3
gtgtttgacagtagg

SEQ ID NO: 79628 - DNA, 15 bp, Artificial Sequence
  dgRNA
  Rasa3
ttagccaatgaagat

SEQ ID NO: 79629 - DNA, 15 bp, Artificial Sequence
  dgRNA
  Rasa3
tagccaatgaagatc

SEQ ID NO: 79630 - DNA, 15 bp, Artificial Sequence
  dgRNA
  Tas2r130
tgcggagaagataaa

SEQ ID NO: 79631 - DNA, 15 bp, Artificial Sequence
  dgRNA
  Tas2r130
ggacatacaatatcc

SEQ ID NO: 79632 - DNA, 15 bp, Artificial Sequence
  dgRNA
  Tas2r130
acaatatccaggcta

SEQ ID NO: 79633 - DNA, 15 bp, Artificial Sequence
  dgRNA
  Tas2r130
gacttcaacttaagg

SEQ ID NO: 79634 - DNA, 15 bp, Artificial Sequence
  dgRNA
  Fbxo8
tcgcgcagcttcttc

SEQ ID NO: 79635 - DNA, 15 bp, Artificial Sequence
  dgRNA
  Fbxo8
tggcgaatctgaatg

SEQ ID NO: 79636 - DNA, 15 bp, Artificial Sequence
  dgRNA
  Fbxo8
tgcgcgaacggagtg

SEQ ID NO: 79637 - DNA, 15 bp, Artificial Sequence
  dgRNA
  Fbxo8
aagaagctgcgcgaa

SEQ ID NO: 79638 - DNA, 15 bp, Artificial Sequence
  dgRNA
  Tac2
gcatgcgcgcgtgtc

SEQ ID NO: 79639 - DNA, 15 bp, Artificial Sequence
  dgRNA
  Tac2
catgcgcgcgtgtct

SEQ ID NO: 79640 - DNA, 15 bp, Artificial Sequence
  dgRNA
  Tac2
cctttatcagggagc

SEQ ID NO: 79641 - DNA, 15 bp, Artificial Sequence
  dgRNA
  Tac2
tcaccaatcccaggg

SEQ ID NO: 79642 - DNA, 15 bp, Artificial Sequence
  dgRNA
  Sgms1
cttaaaagcttagac

SEQ ID NO: 79643 - DNA, 15 bp, Artificial Sequence
  dgRNA
  Sgms1
taaaagcttagactg

SEQ ID NO: 79644 - DNA, 15 bp, Artificial Sequence
  dgRNA
  Sgms1
gtcctaaatcaagaa

SEQ ID NO: 79645 - DNA, 15 bp, Artificial Sequence
  dgRNA
  Sgms1
cttaaccaacagtga

SEQ ID NO: 79646 - DNA, 15 bp, Artificial Sequence
  dgRNA
  Slc36a2
gcactgtggttgatt

SEQ ID NO: 79647 - DNA, 15 bp, Artificial Sequence
  dgRNA
  Slc36a2
gcggggtgtccatgc

SEQ ID NO: 79648 - DNA, 15 bp, Artificial Sequence
  dgRNA
  Tekt2
ctcccggatcccccg

SEQ ID NO: 79649 - DNA, 15 bp, Artificial Sequence
  dgRNA
  Tekt2
tcccggatcccccgt

SEQ ID NO: 79650 - DNA, 15 bp, Artificial Sequence
  dgRNA
  Tekt2
gatcccccgtgggcc

SEQ ID NO: 79651 - DNA, 15 bp, Artificial Sequence
  dgRNA
  Tekt2
gattgttggaagtag

SEQ ID NO: 79652 - DNA, 15 bp, Artificial Sequence
  dgRNA
  Aff1
gaagtgcgggcgaac

SEQ ID NO: 79653 - DNA, 15 bp, Artificial Sequence
  dgRNA
  Aff1
aagtgcgggcgaact

SEQ ID NO: 79654 - DNA, 15 bp, Artificial Sequence
  dgRNA
  Aff1
ggcgaactgggagcc

SEQ ID NO: 79655 - DNA, 15 bp, Artificial Sequence
  dgRNA
  Aff1
ccgcagcgggcggtg

SEQ ID NO: 79656 - DNA, 15 bp, Artificial Sequence
  dgRNA
  Rreb1
ccgagcgcaggaatc

SEQ ID NO: 79657 - DNA, 15 bp, Artificial Sequence
  dgRNA
  Rreb1
agccctgccgggact

SEQ ID NO: 79658 - DNA, 15 bp, Artificial Sequence
  dgRNA
  Rreb1
ctgccgggactcgga

SEQ ID NO: 79659 - DNA, 15 bp, Artificial Sequence
  dgRNA
  Rreb1
atggtgcgcgcaccg

SEQ ID NO: 79660 - DNA, 15 bp, Artificial Sequence
  dgRNA
  Cherp
aacccagagtaccgc

SEQ ID NO: 79661 - DNA, 15 bp, Artificial Sequence
  dgRNA
  Cherp
cacgctccagcgcgt

SEQ ID NO: 79662 - DNA, 15 bp, Artificial Sequence
  dgRNA
  Cherp
acgctccagcgcgtc

SEQ ID NO: 79663 - DNA, 15 bp, Artificial Sequence
  dgRNA
  Cherp
cgctccagcgcgtcg

SEQ ID NO: 79664 - DNA, 15 bp, Artificial Sequence
  dgRNA
  Seh1l
accacccactcaaat

SEQ ID NO: 79665 - DNA, 15 bp, Artificial Sequence
  dgRNA
  Seh1l
cactcaaattggctg

SEQ ID NO: 79666 - DNA, 15 bp, Artificial Sequence
  dgRNA
  Seh1l
actcaaattggctgc

SEQ ID NO: 79667 - DNA, 15 bp, Artificial Sequence
  dgRNA
  Seh1l
tactagctctgtgca

SEQ ID NO: 79668 - DNA, 15 bp, Artificial Sequence
  dgRNA
  Taar7e
gggagcaactctttc

SEQ ID NO: 79669 - DNA, 15 bp, Artificial Sequence
  dgRNA
  Pan3
caagcggactaccac

SEQ ID NO: 79670 - DNA, 15 bp, Artificial Sequence
  dgRNA
  Pan3
aagcggactaccacc

SEQ ID NO: 79671 - DNA, 15 bp, Artificial Sequence
  dgRNA
  Pan3
gtctcgtgagagcct

SEQ ID NO: 79672 - DNA, 15 bp, Artificial Sequence
  dgRNA
  Pan3
cggcgccgccgccgt

SEQ ID NO: 79673 - DNA, 15 bp, Artificial Sequence
  dgRNA
  Rasgrp3
aaaacagcgctccac

SEQ ID NO: 79674 - DNA, 15 bp, Artificial Sequence
  dgRNA
  Rasgrp3
acagcgctccactgg

SEQ ID NO: 79675 - DNA, 15 bp, Artificial Sequence
  dgRNA
  Rasgrp3
cgctccactggaggc

SEQ ID NO: 79676 - DNA, 15 bp, Artificial Sequence
  dgRNA
  Rasgrp3
gccggaaaactaagt

SEQ ID NO: 79677 - DNA, 15 bp, Artificial Sequence
  dgRNA
  Edem2
actttaattcaccga

SEQ ID NO: 79678 - DNA, 15 bp, Artificial Sequence
  dgRNA
  Edem2
ccgcccattgcatcc

SEQ ID NO: 79679 - DNA, 15 bp, Artificial Sequence
  dgRNA
  Edem2
cgcccattgcatcct

SEQ ID NO: 79680 - DNA, 15 bp, Artificial Sequence
  dgRNA
  Edem2
ttaggagcactttac

SEQ ID NO: 79681 - DNA, 15 bp, Artificial Sequence
  dgRNA
  Tcerg1
taccgctttcaaagt

SEQ ID NO: 79682 - DNA, 15 bp, Artificial Sequence
  dgRNA
  Tcerg1
cgctttcaaagtcgg

SEQ ID NO: 79683 - DNA, 15 bp, Artificial Sequence
  dgRNA
  Tcerg1
gctttcaaagtcggc

SEQ ID NO: 79684 - DNA, 15 bp, Artificial Sequence
  dgRNA
  Tcerg1
caacgtcaagattga

SEQ ID NO: 79685 - DNA, 15 bp, Artificial Sequence
  dgRNA
  Gm11992
gaagggtcactgttc

SEQ ID NO: 79686 - DNA, 15 bp, Artificial Sequence
  dgRNA
  Gm11992
gggagcatttaggca

SEQ ID NO: 79687 - DNA, 15 bp, Artificial Sequence
  dgRNA
  Gm11992
ccgccccaccgcgca

SEQ ID NO: 79688 - DNA, 15 bp, Artificial Sequence
  dgRNA
  Gm11992
caccgcgcaaggcag

SEQ ID NO: 79689 - DNA, 15 bp, Artificial Sequence
  dgRNA
  Sp8
aatttctcatccaat

SEQ ID NO: 79690 - DNA, 15 bp, Artificial Sequence
  dgRNA
  Sp8
ttactgcatgccaag

SEQ ID NO: 79691 - DNA, 15 bp, Artificial Sequence
  dgRNA
  Tpgs2
gaaaggcccgcccct

SEQ ID NO: 79692 - DNA, 15 bp, Artificial Sequence
  dgRNA
  Tpgs2
ggcccgcccctaggc

SEQ ID NO: 79693 - DNA, 15 bp, Artificial Sequence
  dgRNA
  Tpgs2
gcccgcccctaggcc

SEQ ID NO: 79694 - DNA, 15 bp, Artificial Sequence
  dgRNA
  Tpgs2
cccgcccctaggccg

SEQ ID NO: 79695 - DNA, 15 bp, Artificial Sequence
  dgRNA
  B3galnt1
cttaggcgaagcctg

SEQ ID NO: 79696 - DNA, 15 bp, Artificial Sequence
  dgRNA
  B3galnt1
aggcgaagcctgcgg

SEQ ID NO: 79697 - DNA, 15 bp, Artificial Sequence
  dgRNA
  B3galnt1
cggtggccgtgatgc

SEQ ID NO: 79698 - DNA, 15 bp, Artificial Sequence
  dgRNA
  B3galnt1
gctggcgcccgcccg

SEQ ID NO: 79699 - DNA, 15 bp, Artificial Sequence
  dgRNA
  Adprm
gcgacctcaccactg

SEQ ID NO: 79700 - DNA, 15 bp, Artificial Sequence
  dgRNA
  Adprm
agaccgcgcctcctt

SEQ ID NO: 79701 - DNA, 15 bp, Artificial Sequence
  dgRNA
  Adprm
gaccgcgcctccttt

SEQ ID NO: 79702 - DNA, 15 bp, Artificial Sequence
  dgRNA
  Adprm
agcttccgcttctgc

SEQ ID NO: 79703 - DNA, 15 bp, Artificial Sequence
  dgRNA
  Fbxo3
ccgcagggctgaccg

SEQ ID NO: 79704 - DNA, 15 bp, Artificial Sequence
  dgRNA
  Fbxo3
cgcagggctgaccgc

SEQ ID NO: 79705 - DNA, 15 bp, Artificial Sequence
  dgRNA
  Fbxo3
gcagggctgaccgcg

SEQ ID NO: 79706 - DNA, 15 bp, Artificial Sequence
  dgRNA
  Fbxo3
gggctgaccgcgggg

SEQ ID NO: 79707 - DNA, 15 bp, Artificial Sequence
  dgRNA
  Olfr970
atctttaactataac

SEQ ID NO: 79708 - DNA, 15 bp, Artificial Sequence
  dgRNA
  Olfr970
ttcgagctttcactt

SEQ ID NO: 79709 - DNA, 15 bp, Artificial Sequence
  dgRNA
  Csf2rb
gggagcgagctactc

SEQ ID NO: 79710 - DNA, 15 bp, Artificial Sequence
  dgRNA
  Csf2rb
cgtgagtattatcag

SEQ ID NO: 79711 - DNA, 15 bp, Artificial Sequence
  dgRNA
  Csf2rb
gaagctgcttgcgaa

SEQ ID NO: 79712 - DNA, 15 bp, Artificial Sequence
  dgRNA
  Gm7714
gcatcattgccaatt

SEQ ID NO: 79713 - DNA, 15 bp, Artificial Sequence
  dgRNA
  Pomgnt2
cagaactctcataat

SEQ ID NO: 79714 - DNA, 15 bp, Artificial Sequence
  dgRNA
  Pomgnt2
ttctgtgagccgaag

SEQ ID NO: 79715 - DNA, 15 bp, Artificial Sequence
  dgRNA
  Pomgnt2
ccgaagaggtgatcc

SEQ ID NO: 79716 - DNA, 15 bp, Artificial Sequence
  dgRNA
  Pomgnt2
aggtgatcctggccg

SEQ ID NO: 79717 - DNA, 15 bp, Artificial Sequence
  dgRNA
  Oas1f
agccccgccttgcct

SEQ ID NO: 79718 - DNA, 15 bp, Artificial Sequence
  dgRNA
  Oas1f
acgaaaaacctgcta

SEQ ID NO: 79719 - DNA, 15 bp, Artificial Sequence
  dgRNA
  Oas1f
cgttcctaggcaagg

SEQ ID NO: 79720 - DNA, 15 bp, Artificial Sequence
  dgRNA
  Oas1f
tttcgttcctaggca

SEQ ID NO: 79721 - DNA, 15 bp, Artificial Sequence
  dgRNA
  Gm4944
gtatggtttattggg

SEQ ID NO: 79722 - DNA, 15 bp, Artificial Sequence
  dgRNA
  Gm4944
tatggtttattgggc

SEQ ID NO: 79723 - DNA, 15 bp, Artificial Sequence
  dgRNA
  Gm4944
ccaggccggagtgac

SEQ ID NO: 79724 - DNA, 15 bp, Artificial Sequence
  dgRNA
  Gm4944
caataaaccatactt

SEQ ID NO: 79725 - DNA, 15 bp, Artificial Sequence
  dgRNA
  Nostrin
tcaaggctacacctc

SEQ ID NO: 79726 - DNA, 15 bp, Artificial Sequence
  dgRNA
  Nostrin
caaggctacacctca

SEQ ID NO: 79727 - DNA, 15 bp, Artificial Sequence
  dgRNA
  Nostrin
ggcctcaaagttcac

SEQ ID NO: 79728 - DNA, 15 bp, Artificial Sequence
  dgRNA
  Nostrin
gtcaaaagagccagt

SEQ ID NO: 79729 - DNA, 15 bp, Artificial Sequence
  dgRNA
  4933408B17Rik
gatatgagcttacca

SEQ ID NO: 79730 - DNA, 15 bp, Artificial Sequence
  dgRNA
  4933408B17Rik
tgagcttaccaaggt

SEQ ID NO: 79731 - DNA, 15 bp, Artificial Sequence
  dgRNA
  4933408B17Rik
gagcttaccaaggtt

SEQ ID NO: 79732 - DNA, 15 bp, Artificial Sequence
  dgRNA
  4933408B17Rik
agcttaccaaggttg

SEQ ID NO: 79733 - DNA, 15 bp, Artificial Sequence
  dgRNA
  Pdgfra
ccgaatcacagagct

SEQ ID NO: 79734 - DNA, 15 bp, Artificial Sequence
  dgRNA
  Pdgfra
tctggcggctgcggt

SEQ ID NO: 79735 - DNA, 15 bp, Artificial Sequence
  dgRNA
  Pdgfra
ggctgcggtcggtgc

SEQ ID NO: 79736 - DNA, 15 bp, Artificial Sequence
  dgRNA
  Pdgfra
gcggtcggtgctggc

SEQ ID NO: 79737 - DNA, 15 bp, Artificial Sequence
  dgRNA
  Psd3
catctgctctatcaa

SEQ ID NO: 79738 - DNA, 15 bp, Artificial Sequence
  dgRNA
  Psd3
tcccatccaacacag

SEQ ID NO: 79739 - DNA, 15 bp, Artificial Sequence
  dgRNA
  Psd3
gtggctcgtgtgtgc

SEQ ID NO: 79740 - DNA, 15 bp, Artificial Sequence
  dgRNA
  Psd3
accccaacagtaaac

SEQ ID NO: 79741 - DNA, 15 bp, Artificial Sequence
  dgRNA
  Rpgrip1
agacaatagctatgt

SEQ ID NO: 79742 - DNA, 15 bp, Artificial Sequence
  dgRNA
  Rpgrip1
gactctggctaaagc

SEQ ID NO: 79743 - DNA, 15 bp, Artificial Sequence
  dgRNA
  Btbd3
tccaatcctgattgg

SEQ ID NO: 79744 - DNA, 15 bp, Artificial Sequence
  dgRNA
  Btbd3
cttcagctattggct

SEQ ID NO: 79745 - DNA, 15 bp, Artificial Sequence
  dgRNA
  Btbd3
attggctcggagctc

SEQ ID NO: 79746 - DNA, 15 bp, Artificial Sequence
  dgRNA
  Btbd3
ctgactccgtctgca

SEQ ID NO: 79747 - DNA, 15 bp, Artificial Sequence
  dgRNA
  Pla2g6
agcccgaccgccccc

SEQ ID NO: 79748 - DNA, 15 bp, Artificial Sequence
  dgRNA
  Pla2g6
agaagcggcttccat

SEQ ID NO: 79749 - DNA, 15 bp, Artificial Sequence
  dgRNA
  Pla2g6
gaagcggcttccatt

SEQ ID NO: 79750 - DNA, 15 bp, Artificial Sequence
  dgRNA
  Pla2g6
gcctgaccgcgtgcg

SEQ ID NO: 79751 - DNA, 15 bp, Artificial Sequence
  dgRNA
  Josd1
cctcccccgctaccg

SEQ ID NO: 79752 - DNA, 15 bp, Artificial Sequence
  dgRNA
  Josd1
tctaagcacctccac

SEQ ID NO: 79753 - DNA, 15 bp, Artificial Sequence
  dgRNA
  Josd1
accaacagcccgcgt

SEQ ID NO: 79754 - DNA, 15 bp, Artificial Sequence
  dgRNA
  Josd1
acgtcacacaacgtc

SEQ ID NO: 79755 - DNA, 15 bp, Artificial Sequence
  dgRNA
  Hdhd3
gtgataatgagtata

SEQ ID NO: 79756 - DNA, 15 bp, Artificial Sequence
  dgRNA
  Hdhd3
tgataatgagtataa

SEQ ID NO: 79757 - DNA, 15 bp, Artificial Sequence
  dgRNA
  Hdhd3
gagtataagggcagt

SEQ ID NO: 79758 - DNA, 15 bp, Artificial Sequence
  dgRNA
  Hdhd3
agtataagggcagtg

SEQ ID NO: 79759 - DNA, 15 bp, Artificial Sequence
  dgRNA
  Krtap27-1
actatatctttgctg

SEQ ID NO: 79760 - DNA, 15 bp, Artificial Sequence
  dgRNA
  Fpr3
attatggaactttac

SEQ ID NO: 79761 - DNA, 15 bp, Artificial Sequence
  dgRNA
  Fpr3
tgaacagtccaaata

SEQ ID NO: 79762 - DNA, 15 bp, Artificial Sequence
  dgRNA
  Fpr3
gaacagtccaaatag

SEQ ID NO: 79763 - DNA, 15 bp, Artificial Sequence
  dgRNA
  Fpr3
taggggtcatgtaag

SEQ ID NO: 79764 - DNA, 15 bp, Artificial Sequence
  dgRNA
  Trpv5
ctgttttatgccccc

SEQ ID NO: 79765 - DNA, 15 bp, Artificial Sequence
  dgRNA
  Trpv5
gggcataaaacagcc

SEQ ID NO: 79766 - DNA, 15 bp, Artificial Sequence
  dgRNA
  Trpv5
actagccacattgct

SEQ ID NO: 79767 - DNA, 15 bp, Artificial Sequence
  dgRNA
  Trpv5
acttgtgcgtgctgt

SEQ ID NO: 79768 - DNA, 15 bp, Artificial Sequence
  dgRNA
  Thoc7
tcgcccttcacccgc

SEQ ID NO: 79769 - DNA, 15 bp, Artificial Sequence
  dgRNA
  Thoc7
cgcgccccaggagag

SEQ ID NO: 79770 - DNA, 15 bp, Artificial Sequence
  dgRNA
  Thoc7
ggagagcggcgagcg

SEQ ID NO: 79771 - DNA, 15 bp, Artificial Sequence
  dgRNA
  Thoc7
gagagcggcgagcgc

SEQ ID NO: 79772 - DNA, 15 bp, Artificial Sequence
  dgRNA
  Cct8l1
aagacagtcttcgtt

SEQ ID NO: 79773 - DNA, 15 bp, Artificial Sequence
  dgRNA
  Cct8l1
tcattcctgctatca

SEQ ID NO: 79774 - DNA, 15 bp, Artificial Sequence
  dgRNA
  Cct8l1
gagggaactgacgtt

SEQ ID NO: 79775 - DNA, 15 bp, Artificial Sequence
  dgRNA
  Cct8l1
tgagggaactgacgt

SEQ ID NO: 79776 - DNA, 15 bp, Artificial Sequence
  dgRNA
  Ubox5
caaagcgacccatcc

SEQ ID NO: 79777 - DNA, 15 bp, Artificial Sequence
  dgRNA
  Ubox5
ggaaaacttcgacta

SEQ ID NO: 79778 - DNA, 15 bp, Artificial Sequence
  dgRNA
  Ubox5
gaacctcagcggctc

SEQ ID NO: 79779 - DNA, 15 bp, Artificial Sequence
  dgRNA
  Ubox5
aattggcacaggttc

SEQ ID NO: 79780 - DNA, 15 bp, Artificial Sequence
  dgRNA
  Actl9
tgcccaagctagact

SEQ ID NO: 79781 - DNA, 15 bp, Artificial Sequence
  dgRNA
  Actl9
taaggtttatacaag

SEQ ID NO: 79782 - DNA, 15 bp, Artificial Sequence
  dgRNA
  Actl9
tggccaacccagacc

SEQ ID NO: 79783 - DNA, 15 bp, Artificial Sequence
  dgRNA
  Actl9
gatggttagtttaac

SEQ ID NO: 79784 - DNA, 15 bp, Artificial Sequence
  dgRNA
  Ablim1
cagtttgcctgaaag

SEQ ID NO: 79785 - DNA, 15 bp, Artificial Sequence
  dgRNA
  Rgs12
agaagcaggacccgc

SEQ ID NO: 79786 - DNA, 15 bp, Artificial Sequence
  dgRNA
  Rgs12
gaagcaggacccgcg

SEQ ID NO: 79787 - DNA, 15 bp, Artificial Sequence
  dgRNA
  Rgs12
tcccgaagcgcacaa

SEQ ID NO: 79788 - DNA, 15 bp, Artificial Sequence
  dgRNA
  Rgs12
ctgacccgcccctca

SEQ ID NO: 79789 - DNA, 15 bp, Artificial Sequence
  dgRNA
  Setd6
atcagtcggtcacta

SEQ ID NO: 79790 - DNA, 15 bp, Artificial Sequence
  dgRNA
  Setd6
ctgcacgccgctctc

SEQ ID NO: 79791 - DNA, 15 bp, Artificial Sequence
  dgRNA
  Setd6
tgcacgccgctctcc

SEQ ID NO: 79792 - DNA, 15 bp, Artificial Sequence
  dgRNA
  Setd6
ccgctctccgggaca

SEQ ID NO: 79793 - DNA, 15 bp, Artificial Sequence
  dgRNA
  Fhod1
tagcaatggaactaa

SEQ ID NO: 79794 - DNA, 15 bp, Artificial Sequence
  dgRNA
  Fhod1
cccaagcgccgcctc

SEQ ID NO: 79795 - DNA, 15 bp, Artificial Sequence
  dgRNA
  Fhod1
aagcgccgcctccgg

SEQ ID NO: 79796 - DNA, 15 bp, Artificial Sequence
  dgRNA
  Fhod1
cgccgcctccggcgg

SEQ ID NO: 79797 - DNA, 15 bp, Artificial Sequence
  dgRNA
  Taf6l
aactagaaagcggta

SEQ ID NO: 79798 - DNA, 15 bp, Artificial Sequence
  dgRNA
  Glyat
tatagtaaaggcaag

SEQ ID NO: 79799 - DNA, 15 bp, Artificial Sequence
  dgRNA
  Glyat
ctatcaatgccagaa

SEQ ID NO: 79800 - DNA, 15 bp, Artificial Sequence
  dgRNA
  Gpr85
cagtattactaacgt

SEQ ID NO: 79801 - DNA, 15 bp, Artificial Sequence
  dgRNA
  Gpr85
ttgccctgatttgat

SEQ ID NO: 79802 - DNA, 15 bp, Artificial Sequence
  dgRNA
  Gpr85
ctattggatacatag

SEQ ID NO: 79803 - DNA, 15 bp, Artificial Sequence
  dgRNA
  Zfhx2
gctagctgtctatag

SEQ ID NO: 79804 - DNA, 15 bp, Artificial Sequence
  dgRNA
  Zfhx2
ctagctgtctataga

SEQ ID NO: 79805 - DNA, 15 bp, Artificial Sequence
  dgRNA
  Zfhx2
gctgtctatagaggg

SEQ ID NO: 79806 - DNA, 15 bp, Artificial Sequence
  dgRNA
  Zfhx2
cagtatgcattgcgg

SEQ ID NO: 79807 - DNA, 15 bp, Artificial Sequence
  dgRNA
  Cldn6
gttactgaactcagc

SEQ ID NO: 79808 - DNA, 15 bp, Artificial Sequence
  dgRNA
  Cldn6
agcaggttccgccct

SEQ ID NO: 79809 - DNA, 15 bp, Artificial Sequence
  dgRNA
  Cldn6
gttccgcccttggag

SEQ ID NO: 79810 - DNA, 15 bp, Artificial Sequence
  dgRNA
  Cldn6
agtggccaccaacta

SEQ ID NO: 79811 - DNA, 15 bp, Artificial Sequence
  dgRNA
  Tarbp2
ctcacagtgtcggct

SEQ ID NO: 79812 - DNA, 15 bp, Artificial Sequence
  dgRNA
  Tarbp2
tcacagtgtcggctt

SEQ ID NO: 79813 - DNA, 15 bp, Artificial Sequence
  dgRNA
  Tarbp2
cagtgtcggcttggg

SEQ ID NO: 79814 - DNA, 15 bp, Artificial Sequence
  dgRNA
  Tarbp2
tgtcggcttgggagg

SEQ ID NO: 79815 - DNA, 15 bp, Artificial Sequence
  dgRNA
  Bsn
tcattcaacacccgc

SEQ ID NO: 79816 - DNA, 15 bp, Artificial Sequence
  dgRNA
  Bsn
acccgccggccgcgt

SEQ ID NO: 79817 - DNA, 15 bp, Artificial Sequence
  dgRNA
  Bsn
cggccgcgttggctg

SEQ ID NO: 79818 - DNA, 15 bp, Artificial Sequence
  dgRNA
  Bsn
ccgcgttggctgcgg

SEQ ID NO: 79819 - DNA, 15 bp, Artificial Sequence
  dgRNA
  BC049730
atcgcatgccttccg

SEQ ID NO: 79820 - DNA, 15 bp, Artificial Sequence
  dgRNA
  BC049730
gcatgccttccgagg

SEQ ID NO: 79821 - DNA, 15 bp, Artificial Sequence
  dgRNA
  BC049730
gaggcggccagttat

SEQ ID NO: 79822 - DNA, 15 bp, Artificial Sequence
  dgRNA
  BC049730
tactcattaaccaat

SEQ ID NO: 79823 - DNA, 15 bp, Artificial Sequence
  dgRNA
  Blcap
gaccaaatattccac

SEQ ID NO: 79824 - DNA, 15 bp, Artificial Sequence
  dgRNA
  Blcap
agaaaggacatttcg

SEQ ID NO: 79825 - DNA, 15 bp, Artificial Sequence
  dgRNA
  Blcap
aaggacatttcgtgg

SEQ ID NO: 79826 - DNA, 15 bp, Artificial Sequence
  dgRNA
  Blcap
tcgtggcggatactg

SEQ ID NO: 79827 - DNA, 15 bp, Artificial Sequence
  dgRNA
  Lhfpl4
ggaggcctgaagccg

SEQ ID NO: 79828 - DNA, 15 bp, Artificial Sequence
  dgRNA
  Lhfpl4
tagaggctatgtttc

SEQ ID NO: 79829 - DNA, 15 bp, Artificial Sequence
  dgRNA
  Lhfpl4
ttctttacgcccgcg

SEQ ID NO: 79830 - DNA, 15 bp, Artificial Sequence
  dgRNA
  Lhfpl4
tctttacgcccgcgc

SEQ ID NO: 79831 - DNA, 15 bp, Artificial Sequence
  dgRNA
  A730017C20Rik
aattcatttcgagct

SEQ ID NO: 79832 - DNA, 15 bp, Artificial Sequence
  dgRNA
  Tspan13
ctccagacagtctcg

SEQ ID NO: 79833 - DNA, 15 bp, Artificial Sequence
  dgRNA
  Tspan13
gtgcagggcgagacg

SEQ ID NO: 79834 - DNA, 15 bp, Artificial Sequence
  dgRNA
  Tspan13
cagggcgagacgagg

SEQ ID NO: 79835 - DNA, 15 bp, Artificial Sequence
  dgRNA
  Tspan13
ggcgagacgaggcgg

SEQ ID NO: 79836 - DNA, 15 bp, Artificial Sequence
  dgRNA
  Spef2
tttttgcactagcac

SEQ ID NO: 79837 - DNA, 15 bp, Artificial Sequence
  dgRNA
  Spef2
cactagcacaggttc

SEQ ID NO: 79838 - DNA, 15 bp, Artificial Sequence
  dgRNA
  Spef2
gtcttacaagccagt

SEQ ID NO: 79839 - DNA, 15 bp, Artificial Sequence
  dgRNA
  Spef2
tcttacaagccagta

SEQ ID NO: 79840 - DNA, 15 bp, Artificial Sequence
  dgRNA
  Bcat1
agtacagcgtatgat

SEQ ID NO: 79841 - DNA, 15 bp, Artificial Sequence
  dgRNA
  Bcat1
gtacagcgtatgatt

SEQ ID NO: 79842 - DNA, 15 bp, Artificial Sequence
  dgRNA
  Bcat1
tacagcgtatgattg

SEQ ID NO: 79843 - DNA, 15 bp, Artificial Sequence
  dgRNA
  Bcat1
acagcgtatgattgg

SEQ ID NO: 79844 - DNA, 15 bp, Artificial Sequence
  dgRNA
  Klrk1
aaattccccctgtct

SEQ ID NO: 79845 - DNA, 15 bp, Artificial Sequence
  dgRNA
  Klrk1
ctcatccaagacagg

SEQ ID NO: 79846 - DNA, 15 bp, Artificial Sequence
  dgRNA
  Klrk1
gctcatccaagacag

SEQ ID NO: 79847 - DNA, 15 bp, Artificial Sequence
  dgRNA
  Snx19
gctggccgcggcggt

SEQ ID NO: 79848 - DNA, 15 bp, Artificial Sequence
  dgRNA
  Snx19
gccgcggcggtcgga

SEQ ID NO: 79849 - DNA, 15 bp, Artificial Sequence
  dgRNA
  Snx19
caagagttcgttccc

SEQ ID NO: 79850 - DNA, 15 bp, Artificial Sequence
  dgRNA
  Snx19
aagagttcgttccca

SEQ ID NO: 79851 - DNA, 15 bp, Artificial Sequence
  dgRNA
  Ube2d1
cgcagctgtcaccca

SEQ ID NO: 79852 - DNA, 15 bp, Artificial Sequence
  dgRNA
  Ube2d1
tcacccacgggtgac

SEQ ID NO: 79853 - DNA, 15 bp, Artificial Sequence
  dgRNA
  Ube2d1
cggacgacgtccgcg

SEQ ID NO: 79854 - DNA, 15 bp, Artificial Sequence
  dgRNA
  Ube2d1
ggacgacgtccgcgc

SEQ ID NO: 79855 - DNA, 15 bp, Artificial Sequence
  dgRNA
  C1d
ggcggggcaagcctc

SEQ ID NO: 79856 - DNA, 15 bp, Artificial Sequence
  dgRNA
  C1d
gcgcacgcgcacgac

SEQ ID NO: 79857 - DNA, 15 bp, Artificial Sequence
  dgRNA
  C1d
cgcacgcgcacgacc

SEQ ID NO: 79858 - DNA, 15 bp, Artificial Sequence
  dgRNA
  C1d
accgggagagacgca

SEQ ID NO: 79859 - DNA, 15 bp, Artificial Sequence
  dgRNA
  Mybphl
cctcctaatgctgta

SEQ ID NO: 79860 - DNA, 15 bp, Artificial Sequence
  dgRNA
  Mybphl
cactcacaagataac

SEQ ID NO: 79861 - DNA, 15 bp, Artificial Sequence
  dgRNA
  Mybphl
actcacaagataaca

SEQ ID NO: 79862 - DNA, 15 bp, Artificial Sequence
  dgRNA
  Mybphl
tcagccctcctcccg

SEQ ID NO: 79863 - DNA, 15 bp, Artificial Sequence
  dgRNA
  Med21
ccgcctgacgtcagc

SEQ ID NO: 79864 - DNA, 15 bp, Artificial Sequence
  dgRNA
  Med21
cgtcagcaggcccgc

SEQ ID NO: 79865 - DNA, 15 bp, Artificial Sequence
  dgRNA
  Med21
taaccacgcccctca

SEQ ID NO: 79866 - DNA, 15 bp, Artificial Sequence
  dgRNA
  Med21
ccacgcccctcaagg

SEQ ID NO: 79867 - DNA, 15 bp, Artificial Sequence
  dgRNA
  Mamdc4
ttacagctagatgct

SEQ ID NO: 79868 - DNA, 15 bp, Artificial Sequence
  dgRNA
  Mamdc4
ttggcctgtcatcat

SEQ ID NO: 79869 - DNA, 15 bp, Artificial Sequence
  dgRNA
  Mamdc4
cctgtcatcatcgga

SEQ ID NO: 79870 - DNA, 15 bp, Artificial Sequence
  dgRNA
  Mamdc4
ctgtcatcatcggat

SEQ ID NO: 79871 - DNA, 15 bp, Artificial Sequence
  dgRNA
  Ugt2b5
cactctcatgtaaaa

SEQ ID NO: 79872 - DNA, 15 bp, Artificial Sequence
  dgRNA
  Ugt2b5
atgatcatataagat

SEQ ID NO: 79873 - DNA, 15 bp, Artificial Sequence
  dgRNA
  Ugt2b5
tgatcatataagatt

SEQ ID NO: 79874 - DNA, 15 bp, Artificial Sequence
  dgRNA
  Gbp6
cagcttacataaaag

SEQ ID NO: 79875 - DNA, 15 bp, Artificial Sequence
  dgRNA
  Gbp6
taggccatgttaact

SEQ ID NO: 79876 - DNA, 15 bp, Artificial Sequence
  dgRNA
  Perm1
cctagtgttaatcat

SEQ ID NO: 79877 - DNA, 15 bp, Artificial Sequence
  dgRNA
  Perm1
ctagtgttaatcata

SEQ ID NO: 79878 - DNA, 15 bp, Artificial Sequence
  dgRNA
  Perm1
tctctagttggaatc

SEQ ID NO: 79879 - DNA, 15 bp, Artificial Sequence
  dgRNA
  Perm1
gccaaccccgagtgc

SEQ ID NO: 79880 - DNA, 15 bp, Artificial Sequence
  dgRNA
  Nr2f6
ccccgatgccccgac

SEQ ID NO: 79881 - DNA, 15 bp, Artificial Sequence
  dgRNA
  Nr2f6
cccgacaggactcgc

SEQ ID NO: 79882 - DNA, 15 bp, Artificial Sequence
  dgRNA
  Nr2f6
ccgacaggactcgca

SEQ ID NO: 79883 - DNA, 15 bp, Artificial Sequence
  dgRNA
  Nr2f6
cgacaggactcgcag

SEQ ID NO: 79884 - DNA, 15 bp, Artificial Sequence
  dgRNA
  Sprtn
cgagcccggtggaga

SEQ ID NO: 79885 - DNA, 15 bp, Artificial Sequence
  dgRNA
  Sprtn
cccaaacgcctgcgc

SEQ ID NO: 79886 - DNA, 15 bp, Artificial Sequence
  dgRNA
  Sprtn
actgcgcctgcgccc

SEQ ID NO: 79887 - DNA, 15 bp, Artificial Sequence
  dgRNA
  Sprtn
ctgcgcctgcgcccg

SEQ ID NO: 79888 - DNA, 15 bp, Artificial Sequence
  dgRNA
  Ssr2
tatcagccgccataa

SEQ ID NO: 79889 - DNA, 15 bp, Artificial Sequence
  dgRNA
  Ssr2
atcagccgccataaa

SEQ ID NO: 79890 - DNA, 15 bp, Artificial Sequence
  dgRNA
  Ssr2
tcagccgccataaag

SEQ ID NO: 79891 - DNA, 15 bp, Artificial Sequence
  dgRNA
  Ssr2
ccgccataaagggga

SEQ ID NO: 79892 - DNA, 15 bp, Artificial Sequence
  dgRNA
  Dhrs4
gcgcggggcgccagc

SEQ ID NO: 79893 - DNA, 15 bp, Artificial Sequence
  dgRNA
  Dhrs4
cgcggggcgccagca

SEQ ID NO: 79894 - DNA, 15 bp, Artificial Sequence
  dgRNA
  Dhrs4
cgctcgcaaccgccg

SEQ ID NO: 79895 - DNA, 15 bp, Artificial Sequence
  dgRNA
  Dhrs4
ggagagtcgttggag

SEQ ID NO: 79896 - DNA, 15 bp, Artificial Sequence
  dgRNA
  Emc2
tcgaccaataaaaac

SEQ ID NO: 79897 - DNA, 15 bp, Artificial Sequence
  dgRNA
  Emc2
ccagcggggagctga

SEQ ID NO: 79898 - DNA, 15 bp, Artificial Sequence
  dgRNA
  Emc2
gaagccggagaggcg

SEQ ID NO: 79899 - DNA, 15 bp, Artificial Sequence
  dgRNA
  Emc2
agtggccagactagt

SEQ ID NO: 79900 - DNA, 15 bp, Artificial Sequence
  dgRNA
  Supv3l1
cactgtaacgtacag

SEQ ID NO: 79901 - DNA, 15 bp, Artificial Sequence
  dgRNA
  Supv3l1
cgtgctcccacgaag

SEQ ID NO: 79902 - DNA, 15 bp, Artificial Sequence
  dgRNA
  Supv3l1
tccttcaggcgcacg

SEQ ID NO: 79903 - DNA, 15 bp, Artificial Sequence
  dgRNA
  Supv3l1
ccttcaggcgcacgc

SEQ ID NO: 79904 - DNA, 15 bp, Artificial Sequence
  dgRNA
  Tmem50b
accgcaaaccgcagc

SEQ ID NO: 79905 - DNA, 15 bp, Artificial Sequence
  dgRNA
  Tmem50b
ccggacctcagctcc

SEQ ID NO: 79906 - DNA, 15 bp, Artificial Sequence
  dgRNA
  Tmem50b
tcagctccaggacgc

SEQ ID NO: 79907 - DNA, 15 bp, Artificial Sequence
  dgRNA
  Tmem50b
cgccctctatctaat

SEQ ID NO: 79908 - DNA, 15 bp, Artificial Sequence
  dgRNA
  Gak
aaccagatgaggtta

SEQ ID NO: 79909 - DNA, 15 bp, Artificial Sequence
  dgRNA
  Gak
acctccgtgcctcct

SEQ ID NO: 79910 - DNA, 15 bp, Artificial Sequence
  dgRNA
  Gak
gagcttgaggtccgt

SEQ ID NO: 79911 - DNA, 15 bp, Artificial Sequence
  dgRNA
  Gak
tccgcctgctgcgtc

SEQ ID NO: 79912 - DNA, 15 bp, Artificial Sequence
  dgRNA
  Pnpla5
ttaggtgagtgtaat

SEQ ID NO: 79913 - DNA, 15 bp, Artificial Sequence
  dgRNA
  Pnpla5
taggtgagtgtaatt

SEQ ID NO: 79914 - DNA, 15 bp, Artificial Sequence
  dgRNA
  Pnpla5
ttgtaatgtaatgcc

SEQ ID NO: 79915 - DNA, 15 bp, Artificial Sequence
  dgRNA
  Pnpla5
aacccctcacttgct

SEQ ID NO: 79916 - DNA, 15 bp, Artificial Sequence
  dgRNA
  Nthl1
gcgcctttcgcgcgc

SEQ ID NO: 79917 - DNA, 15 bp, Artificial Sequence
  dgRNA
  Nthl1
aagggcgcacacccc

SEQ ID NO: 79918 - DNA, 15 bp, Artificial Sequence
  dgRNA
  Nthl1
gcacacccccggccc

SEQ ID NO: 79919 - DNA, 15 bp, Artificial Sequence
  dgRNA
  Nthl1
cgcaacccgtacttc

SEQ ID NO: 79920 - DNA, 15 bp, Artificial Sequence
  dgRNA
  Sssca1
gcgttaccagggaga

SEQ ID NO: 79921 - DNA, 15 bp, Artificial Sequence
  dgRNA
  Sssca1
accagccgagcccgt

SEQ ID NO: 79922 - DNA, 15 bp, Artificial Sequence
  dgRNA
  Sssca1
ccgagcccgtaggtc

SEQ ID NO: 79923 - DNA, 15 bp, Artificial Sequence
  dgRNA
  Sssca1
cgagcccgtaggtca

SEQ ID NO: 79924 - DNA, 15 bp, Artificial Sequence
  dgRNA
  Nlrp1b
cagtacccattaccc

SEQ ID NO: 79925 - DNA, 15 bp, Artificial Sequence
  dgRNA
  Nlrp1b
tgtatccaggggttt

SEQ ID NO: 79926 - DNA, 15 bp, Artificial Sequence
  dgRNA
  Nlrp1b
gtgtatccaggggtt

SEQ ID NO: 79927 - DNA, 15 bp, Artificial Sequence
  dgRNA
  Nlrp1b
gggtactgtgtatcc

SEQ ID NO: 79928 - DNA, 15 bp, Artificial Sequence
  dgRNA
  Npat
cccgcaactccgccc

SEQ ID NO: 79929 - DNA, 15 bp, Artificial Sequence
  dgRNA
  Npat
ccgcaactccgccca

SEQ ID NO: 79930 - DNA, 15 bp, Artificial Sequence
  dgRNA
  Npat
cgcaactccgcccag

SEQ ID NO: 79931 - DNA, 15 bp, Artificial Sequence
  dgRNA
  Npat
cgacgctcccacagc

SEQ ID NO: 79932 - DNA, 15 bp, Artificial Sequence
  dgRNA
  Zcchc2
cgtgcggacgcggaa

SEQ ID NO: 79933 - DNA, 15 bp, Artificial Sequence
  dgRNA
  Zcchc2
acgcggaaaggcgga

SEQ ID NO: 79934 - DNA, 15 bp, Artificial Sequence
  dgRNA
  Zcchc2
cggaaaggcggaagg

SEQ ID NO: 79935 - DNA, 15 bp, Artificial Sequence
  dgRNA
  Zcchc2
ttgctcctcccgcac

SEQ ID NO: 79936 - DNA, 15 bp, Artificial Sequence
  dgRNA
  Eef1e1
ctgtgagcaatccac

SEQ ID NO: 79937 - DNA, 15 bp, Artificial Sequence
  dgRNA
  Eef1e1
accggactccgaatg

SEQ ID NO: 79938 - DNA, 15 bp, Artificial Sequence
  dgRNA
  Eef1e1
gactccgaatgtggt

SEQ ID NO: 79939 - DNA, 15 bp, Artificial Sequence
  dgRNA
  Eef1e1
ccgcccctttcgcgc

SEQ ID NO: 79940 - DNA, 15 bp, Artificial Sequence
  dgRNA
  Usp30
gcggagcaaatgcga

SEQ ID NO: 79941 - DNA, 15 bp, Artificial Sequence
  dgRNA
  Usp30
tcatagcttccgaag

SEQ ID NO: 79942 - DNA, 15 bp, Artificial Sequence
  dgRNA
  Usp30
ttccgaagtggtccc

SEQ ID NO: 79943 - DNA, 15 bp, Artificial Sequence
  dgRNA
  Usp30
tccgaagtggtcccc

SEQ ID NO: 79944 - DNA, 15 bp, Artificial Sequence
  dgRNA
  Tor3a
atagcctgcatcccg

SEQ ID NO: 79945 - DNA, 15 bp, Artificial Sequence
  dgRNA
  Tor3a
tagcctgcatcccga

SEQ ID NO: 79946 - DNA, 15 bp, Artificial Sequence
  dgRNA
  Tor3a
agcctgcatcccgag

SEQ ID NO: 79947 - DNA, 15 bp, Artificial Sequence
  dgRNA
  Tor3a
tcccgaggggcagac

SEQ ID NO: 79948 - DNA, 15 bp, Artificial Sequence
  dgRNA
  Six6
gttcagcagtctccc

SEQ ID NO: 79949 - DNA, 15 bp, Artificial Sequence
  dgRNA
  Six6
ctccccggcaaaccg

SEQ ID NO: 79950 - DNA, 15 bp, Artificial Sequence
  dgRNA
  Six6
tccccggcaaaccgt

SEQ ID NO: 79951 - DNA, 15 bp, Artificial Sequence
  dgRNA
  Six6
gggcgctgtcgattc

SEQ ID NO: 79952 - DNA, 15 bp, Artificial Sequence
  dgRNA
  Fbp2
cagctgccaccgtca

SEQ ID NO: 79953 - DNA, 15 bp, Artificial Sequence
  dgRNA
  Fbp2
ctgccaccgtcaggg

SEQ ID NO: 79954 - DNA, 15 bp, Artificial Sequence
  dgRNA
  Fbp2
tgccaccgtcaggga

SEQ ID NO: 79955 - DNA, 15 bp, Artificial Sequence
  dgRNA
  Fbp2
caccgtcagggaggg

SEQ ID NO: 79956 - DNA, 15 bp, Artificial Sequence
  dgRNA
  Pde11a
acctcgggctcacag

SEQ ID NO: 79957 - DNA, 15 bp, Artificial Sequence
  dgRNA
  Pde11a
agtggtccactcagc

SEQ ID NO: 79958 - DNA, 15 bp, Artificial Sequence
  dgRNA
  Pde11a
agccggctccagtgg

SEQ ID NO: 79959 - DNA, 15 bp, Artificial Sequence
  dgRNA
  Pde11a
cggctccagtggcgg

SEQ ID NO: 79960 - DNA, 15 bp, Artificial Sequence
  dgRNA
  Hs3st4
ggatctccgctctcc

SEQ ID NO: 79961 - DNA, 15 bp, Artificial Sequence
  dgRNA
  Hs3st4
gatctccgctctccc

SEQ ID NO: 79962 - DNA, 15 bp, Artificial Sequence
  dgRNA
  Hs3st4
cgggcgccccagcct

SEQ ID NO: 79963 - DNA, 15 bp, Artificial Sequence
  dgRNA
  Hs3st4
gcgcaccccctccgc

SEQ ID NO: 79964 - DNA, 15 bp, Artificial Sequence
  dgRNA
  Cstb
ttcacgaccattgag

SEQ ID NO: 79965 - DNA, 15 bp, Artificial Sequence
  dgRNA
  Cstb
cattgaggggcaatc

SEQ ID NO: 79966 - DNA, 15 bp, Artificial Sequence
  dgRNA
  Cstb
tcttagcgtccgttc

SEQ ID NO: 79967 - DNA, 15 bp, Artificial Sequence
  dgRNA
  Cstb
cttagcgtccgttca

SEQ ID NO: 79968 - DNA, 15 bp, Artificial Sequence
  dgRNA
  Tdrd1
aggcgaggtgagcac

SEQ ID NO: 79969 - DNA, 15 bp, Artificial Sequence
  dgRNA
  Tdrd1
cgaggtgagcacggg

SEQ ID NO: 79970 - DNA, 15 bp, Artificial Sequence
  dgRNA
  Samd4
ccgtcacccatgtgc

SEQ ID NO: 79971 - DNA, 15 bp, Artificial Sequence
  dgRNA
  Samd4
ccactcaataatgac

SEQ ID NO: 79972 - DNA, 15 bp, Artificial Sequence
  dgRNA
  Samd4
gcacatgggtgacgg

SEQ ID NO: 79973 - DNA, 15 bp, Artificial Sequence
  dgRNA
  Samd4
ggagcaatgctaaga

SEQ ID NO: 79974 - DNA, 15 bp, Artificial Sequence
  dgRNA
  Pla2g2d
tcatgtatctagaat

SEQ ID NO: 79975 - DNA, 15 bp, Artificial Sequence
  dgRNA
  Fhl2
ggagcgtcaaacacc

SEQ ID NO: 79976 - DNA, 15 bp, Artificial Sequence
  dgRNA
  Fhl2
tgaggcatacagccc

SEQ ID NO: 79977 - DNA, 15 bp, Artificial Sequence
  dgRNA
  Fhl2
gaggcatacagccct

SEQ ID NO: 79978 - DNA, 15 bp, Artificial Sequence
  dgRNA
  Fhl2
agcttacacggacaa

SEQ ID NO: 79979 - DNA, 15 bp, Artificial Sequence
  dgRNA
  Aoc3
cccaggagaatatca

SEQ ID NO: 79980 - DNA, 15 bp, Artificial Sequence
  dgRNA
  Aoc3
aagagccacaaggcg

SEQ ID NO: 79981 - DNA, 15 bp, Artificial Sequence
  dgRNA
  Aoc3
gccacaaggcggggc

SEQ ID NO: 79982 - DNA, 15 bp, Artificial Sequence
  dgRNA
  Aoc3
ccacaaggcggggct

SEQ ID NO: 79983 - DNA, 15 bp, Artificial Sequence
  dgRNA
  Plcb2
cttccggaccagtac

SEQ ID NO: 79984 - DNA, 15 bp, Artificial Sequence
  dgRNA
  Plcb2
ttccggaccagtact

SEQ ID NO: 79985 - DNA, 15 bp, Artificial Sequence
  dgRNA
  Plcb2
cggaccagtactggg

SEQ ID NO: 79986 - DNA, 15 bp, Artificial Sequence
  dgRNA
  Plcb2
ggaccagtactgggc

SEQ ID NO: 79987 - DNA, 15 bp, Artificial Sequence
  dgRNA
  Kif1bp
aagccatactgctca

SEQ ID NO: 79988 - DNA, 15 bp, Artificial Sequence
  dgRNA
  Kif1bp
agccatactgctcaa

SEQ ID NO: 79989 - DNA, 15 bp, Artificial Sequence
  dgRNA
  Kif1bp
aagggtagcagcgga

SEQ ID NO: 79990 - DNA, 15 bp, Artificial Sequence
  dgRNA
  Kif1bp
tcgtttccttgacga

SEQ ID NO: 79991 - DNA, 15 bp, Artificial Sequence
  dgRNA
  Chrne
tccgggctaggtttg

SEQ ID NO: 79992 - DNA, 15 bp, Artificial Sequence
  dgRNA
  Chrne
ttccgggctaggttt

SEQ ID NO: 79993 - DNA, 15 bp, Artificial Sequence
  dgRNA
  Chrne
gttccgggctaggtt

SEQ ID NO: 79994 - DNA, 15 bp, Artificial Sequence
  dgRNA
  Chrne
tgttagttccgggct

SEQ ID NO: 79995 - DNA, 15 bp, Artificial Sequence
  dgRNA
  Tlr5
cctacctcagttaca

SEQ ID NO: 79996 - DNA, 15 bp, Artificial Sequence
  dgRNA
  Tlr5
gaggtacctaggctg

SEQ ID NO: 79997 - DNA, 15 bp, Artificial Sequence
  dgRNA
  Tlr5
cctgatcaagagttg

SEQ ID NO: 79998 - DNA, 15 bp, Artificial Sequence
  dgRNA
  Tlr5
ctgatcaagagttgt

SEQ ID NO: 79999 - DNA, 15 bp, Artificial Sequence
  dgRNA
  Stk33
gcgttttacttgaca

SEQ ID NO: 80000 - DNA, 15 bp, Artificial Sequence
  dgRNA
  Stk33
ttgacacggtgctcg

SEQ ID NO: 80001 - DNA, 15 bp, Artificial Sequence
  dgRNA
  Stk33
cacggtgctcgaggc

SEQ ID NO: 80002 - DNA, 15 bp, Artificial Sequence
  dgRNA
  Stk33
tccccgctccgtgtc

SEQ ID NO: 80003 - DNA, 15 bp, Artificial Sequence
  dgRNA
  Pde4a
ttgcactccgccctc

SEQ ID NO: 80004 - DNA, 15 bp, Artificial Sequence
  dgRNA
  Pde4a
tgcactccgccctct

SEQ ID NO: 80005 - DNA, 15 bp, Artificial Sequence
  dgRNA
  Pde4a
gcactccgccctctg

SEQ ID NO: 80006 - DNA, 15 bp, Artificial Sequence
  dgRNA
  Pde4a
atctggttcccccgc

SEQ ID NO: 80007 - DNA, 15 bp, Artificial Sequence
  dgRNA
  Zfp951
gggcacagcttgttt

SEQ ID NO: 80008 - DNA, 15 bp, Artificial Sequence
  dgRNA
  Zfp951
actggcaggcgcata

SEQ ID NO: 80009 - DNA, 15 bp, Artificial Sequence
  dgRNA
  Wipf1
gtgggaactgttaac

SEQ ID NO: 80010 - DNA, 15 bp, Artificial Sequence
  dgRNA
  Mapk11
ttgtcacggtctccg

SEQ ID NO: 80011 - DNA, 15 bp, Artificial Sequence
  dgRNA
  Mapk11
tgtcacggtctccga

SEQ ID NO: 80012 - DNA, 15 bp, Artificial Sequence
  dgRNA
  Mapk11
cggtctccgaggggc

SEQ ID NO: 80013 - DNA, 15 bp, Artificial Sequence
  dgRNA
  Mapk11
cgtttccccgccctc

SEQ ID NO: 80014 - DNA, 15 bp, Artificial Sequence
  dgRNA
  U2surp
gctcgcatctaacgc

SEQ ID NO: 80015 - DNA, 15 bp, Artificial Sequence
  dgRNA
  U2surp
gcatctaacgccggt

SEQ ID NO: 80016 - DNA, 15 bp, Artificial Sequence
  dgRNA
  U2surp
aacgccggttggctc

SEQ ID NO: 80017 - DNA, 15 bp, Artificial Sequence
  dgRNA
  U2surp
acgccggttggctct

SEQ ID NO: 80018 - DNA, 15 bp, Artificial Sequence
  dgRNA
  Ggps1
tccctcaatactttc

SEQ ID NO: 80019 - DNA, 15 bp, Artificial Sequence
  dgRNA
  Ggps1
ccctcaatactttct

SEQ ID NO: 80020 - DNA, 15 bp, Artificial Sequence
  dgRNA
  Ggps1
gtcttctaggccaat

SEQ ID NO: 80021 - DNA, 15 bp, Artificial Sequence
  dgRNA
  Ggps1
caatcggtaaactga

SEQ ID NO: 80022 - DNA, 15 bp, Artificial Sequence
  dgRNA
  Srp9
accacgactgtgact

SEQ ID NO: 80023 - DNA, 15 bp, Artificial Sequence
  dgRNA
  Srp9
ccacgactgtgactt

SEQ ID NO: 80024 - DNA, 15 bp, Artificial Sequence
  dgRNA
  Srp9
gagctccttagtctt

SEQ ID NO: 80025 - DNA, 15 bp, Artificial Sequence
  dgRNA
  Srp9
cccgacctctcagag

SEQ ID NO: 80026 - DNA, 15 bp, Artificial Sequence
  dgRNA
  Phldb1
cgggcgctgtgcaag

SEQ ID NO: 80027 - DNA, 15 bp, Artificial Sequence
  dgRNA
  Phldb1
gggcgctgtgcaagc

SEQ ID NO: 80028 - DNA, 15 bp, Artificial Sequence
  dgRNA
  Phldb1
ggcgctgtgcaagcg

SEQ ID NO: 80029 - DNA, 15 bp, Artificial Sequence
  dgRNA
  Phldb1
gcgctgtgcaagcgg

SEQ ID NO: 80030 - DNA, 15 bp, Artificial Sequence
  dgRNA
  Adgrg1
aatggcgctgcagac

SEQ ID NO: 80031 - DNA, 15 bp, Artificial Sequence
  dgRNA
  Adgrg1
cacaatatgtcctgc

SEQ ID NO: 80032 - DNA, 15 bp, Artificial Sequence
  dgRNA
  Mrpl24
atcacctttatgtcc

SEQ ID NO: 80033 - DNA, 15 bp, Artificial Sequence
  dgRNA
  Mrpl24
ttcgtggagaccact

SEQ ID NO: 80034 - DNA, 15 bp, Artificial Sequence
  dgRNA
  Mrpl24
cttcgtggagaccac

SEQ ID NO: 80035 - DNA, 15 bp, Artificial Sequence
  dgRNA
  Mrpl24
cgttcgcgctcttcg

SEQ ID NO: 80036 - DNA, 15 bp, Artificial Sequence
  dgRNA
  Atp1b2
ataaagactgtgcgc

SEQ ID NO: 80037 - DNA, 15 bp, Artificial Sequence
  dgRNA
  Atp1b2
taaagactgtgcgca

SEQ ID NO: 80038 - DNA, 15 bp, Artificial Sequence
  dgRNA
  Atp1b2
ctccccgcactgctg

SEQ ID NO: 80039 - DNA, 15 bp, Artificial Sequence
  dgRNA
  Atp1b2
cgcactgctgaggag

SEQ ID NO: 80040 - DNA, 15 bp, Artificial Sequence
  dgRNA
  Gys2
gttctagataaggag

SEQ ID NO: 80041 - DNA, 15 bp, Artificial Sequence
  dgRNA
  Gys2
ccaccgtgcagtctg

SEQ ID NO: 80042 - DNA, 15 bp, Artificial Sequence
  dgRNA
  Gys2
aggagtttggtctaa

SEQ ID NO: 80043 - DNA, 15 bp, Artificial Sequence
  dgRNA
  Gys2
tggtctaaaggccaa

SEQ ID NO: 80044 - DNA, 15 bp, Artificial Sequence
  dgRNA
  Stac2
tatcggcccccattt

SEQ ID NO: 80045 - DNA, 15 bp, Artificial Sequence
  dgRNA
  Stac2
atcggcccccatttc

SEQ ID NO: 80046 - DNA, 15 bp, Artificial Sequence
  dgRNA
  Stac2
atttgcatagctgcg

SEQ ID NO: 80047 - DNA, 15 bp, Artificial Sequence
  dgRNA
  Stac2
tttgcatagctgcgc

SEQ ID NO: 80048 - DNA, 15 bp, Artificial Sequence
  dgRNA
  Plrg1
cccagtcccgcccag

SEQ ID NO: 80049 - DNA, 15 bp, Artificial Sequence
  dgRNA
  Plrg1
tcgacccctgcgcgg

SEQ ID NO: 80050 - DNA, 15 bp, Artificial Sequence
  dgRNA
  Plrg1
cgacccctgcgcggc

SEQ ID NO: 80051 - DNA, 15 bp, Artificial Sequence
  dgRNA
  Plrg1
ctcggcggagctggg

SEQ ID NO: 80052 - DNA, 15 bp, Artificial Sequence
  dgRNA
  Tigar
ccagggcgttaaccc

SEQ ID NO: 80053 - DNA, 15 bp, Artificial Sequence
  dgRNA
  Tigar
cagggcgttaaccca

SEQ ID NO: 80054 - DNA, 15 bp, Artificial Sequence
  dgRNA
  Tigar
ggcgttaacccaggg

SEQ ID NO: 80055 - DNA, 15 bp, Artificial Sequence
  dgRNA
  Tigar
gcgttaacccagggc

SEQ ID NO: 80056 - DNA, 15 bp, Artificial Sequence
  dgRNA
  Prss21
tgctcccgttcacta

SEQ ID NO: 80057 - DNA, 15 bp, Artificial Sequence
  dgRNA
  Prss21
taccaacagctataa

SEQ ID NO: 80058 - DNA, 15 bp, Artificial Sequence
  dgRNA
  Prss21
ctataatggatgccc

SEQ ID NO: 80059 - DNA, 15 bp, Artificial Sequence
  dgRNA
  Prss21
ccccagacaatcctt

SEQ ID NO: 80060 - DNA, 15 bp, Artificial Sequence
  dgRNA
  Tdpoz5
tactcttcatcccgt

SEQ ID NO: 80061 - DNA, 15 bp, Artificial Sequence
  dgRNA
  Adprhl1
tgtcgctctgccagc

SEQ ID NO: 80062 - DNA, 15 bp, Artificial Sequence
  dgRNA
  Adprhl1
gtcgctctgccagca

SEQ ID NO: 80063 - DNA, 15 bp, Artificial Sequence
  dgRNA
  Adprhl1
tcgctctgccagcag

SEQ ID NO: 80064 - DNA, 15 bp, Artificial Sequence
  dgRNA
  Adprhl1
cgctctgccagcagg

SEQ ID NO: 80065 - DNA, 15 bp, Artificial Sequence
  dgRNA
  Tas2r110
tcagtaatgtataag

SEQ ID NO: 80066 - DNA, 15 bp, Artificial Sequence
  dgRNA
  Tas2r110
cagtaatgtataagt

SEQ ID NO: 80067 - DNA, 15 bp, Artificial Sequence
  dgRNA
  Saa3
ctagatggcgcaatc

SEQ ID NO: 80068 - DNA, 15 bp, Artificial Sequence
  dgRNA
  Saa3
tagatggcgcaatct

SEQ ID NO: 80069 - DNA, 15 bp, Artificial Sequence
  dgRNA
  Saa3
agatggcgcaatctg

SEQ ID NO: 80070 - DNA, 15 bp, Artificial Sequence
  dgRNA
  Saa3
tatgcaagatcaaac

SEQ ID NO: 80071 - DNA, 15 bp, Artificial Sequence
  dgRNA
  Pole3
ctggagtggaacgtc

SEQ ID NO: 80072 - DNA, 15 bp, Artificial Sequence
  dgRNA
  Pole3
acgtccgggatgccg

SEQ ID NO: 80073 - DNA, 15 bp, Artificial Sequence
  dgRNA
  Pole3
tgccgtggaagcgga

SEQ ID NO: 80074 - DNA, 15 bp, Artificial Sequence
  dgRNA
  Pole3
taaaccattgcgaca

SEQ ID NO: 80075 - DNA, 15 bp, Artificial Sequence
  dgRNA
  Zmpste24
atgacccggcttatc

SEQ ID NO: 80076 - DNA, 15 bp, Artificial Sequence
  dgRNA
  Zmpste24
ccggcttatccggtc

SEQ ID NO: 80077 - DNA, 15 bp, Artificial Sequence
  dgRNA
  Zmpste24
ggtccggttaagcac

SEQ ID NO: 80078 - DNA, 15 bp, Artificial Sequence
  dgRNA
  Zmpste24
gtccggttaagcacc

SEQ ID NO: 80079 - DNA, 15 bp, Artificial Sequence
  dgRNA
  Atxn7l2
gtgcgtttcccatag

SEQ ID NO: 80080 - DNA, 15 bp, Artificial Sequence
  dgRNA
  Atxn7l2
ggagtactgtgtctt

SEQ ID NO: 80081 - DNA, 15 bp, Artificial Sequence
  dgRNA
  Atxn7l2
tgcagaacggaggtt

SEQ ID NO: 80082 - DNA, 15 bp, Artificial Sequence
  dgRNA
  Atxn7l2
cttgatgcagaacgg

SEQ ID NO: 80083 - DNA, 15 bp, Artificial Sequence
  dgRNA
  Gm4794
ctgagtggcctacat

SEQ ID NO: 80084 - DNA, 15 bp, Artificial Sequence
  dgRNA
  Gm4794
actgagtggcctaca

SEQ ID NO: 80085 - DNA, 15 bp, Artificial Sequence
  dgRNA
  Olfr693
gcttagctatttaga

SEQ ID NO: 80086 - DNA, 15 bp, Artificial Sequence
  dgRNA
  Olfr693
attgcataccctcag

SEQ ID NO: 80087 - DNA, 15 bp, Artificial Sequence
  dgRNA
  Olfr693
gtctatgcatagaag

SEQ ID NO: 80088 - DNA, 15 bp, Artificial Sequence
  dgRNA
  Olfr693
atctcgataaaagtt

SEQ ID NO: 80089 - DNA, 15 bp, Artificial Sequence
  dgRNA
  Cox8b
taaatcttgtatgga

SEQ ID NO: 80090 - DNA, 15 bp, Artificial Sequence
  dgRNA
  Cox8b
gggccctacacgttg

SEQ ID NO: 80091 - DNA, 15 bp, Artificial Sequence
  dgRNA
  Cox8b
ggccctacacgttga

SEQ ID NO: 80092 - DNA, 15 bp, Artificial Sequence
  dgRNA
  Cox8b
gccctacacgttgag

SEQ ID NO: 80093 - DNA, 15 bp, Artificial Sequence
  dgRNA
  Fezf1
cgagtgcttgcgcgt

SEQ ID NO: 80094 - DNA, 15 bp, Artificial Sequence
  dgRNA
  Fezf1
gagtgcttgcgcgtc

SEQ ID NO: 80095 - DNA, 15 bp, Artificial Sequence
  dgRNA
  Fezf1
agtgcttgcgcgtcg

SEQ ID NO: 80096 - DNA, 15 bp, Artificial Sequence
  dgRNA
  Fezf1
gcttgcgcgtcgggg

SEQ ID NO: 80097 - DNA, 15 bp, Artificial Sequence
  dgRNA
  Cactin
aagcacgctactcgc

SEQ ID NO: 80098 - DNA, 15 bp, Artificial Sequence
  dgRNA
  Cactin
actcgccggtcacct

SEQ ID NO: 80099 - DNA, 15 bp, Artificial Sequence
  dgRNA
  Cactin
ctcgccggtcaccta

SEQ ID NO: 80100 - DNA, 15 bp, Artificial Sequence
  dgRNA
  Cactin
gtcacctagggcgcg

SEQ ID NO: 80101 - DNA, 15 bp, Artificial Sequence
  dgRNA
  Ccdc34
aatgggcggacgact

SEQ ID NO: 80102 - DNA, 15 bp, Artificial Sequence
  dgRNA
  Ccdc34
atgggcggacgactc

SEQ ID NO: 80103 - DNA, 15 bp, Artificial Sequence
  dgRNA
  Ccdc34
tgggcggacgactcg

SEQ ID NO: 80104 - DNA, 15 bp, Artificial Sequence
  dgRNA
  Ccdc34
gtcgctatgacaaca

SEQ ID NO: 80105 - DNA, 15 bp, Artificial Sequence
  dgRNA
  Gpr35
tgtcggggaggaatg

SEQ ID NO: 80106 - DNA, 15 bp, Artificial Sequence
  dgRNA
  Gpr35
gtcggggaggaatgt

SEQ ID NO: 80107 - DNA, 15 bp, Artificial Sequence
  dgRNA
  Gpr35
ttgctgcctccgacc

SEQ ID NO: 80108 - DNA, 15 bp, Artificial Sequence
  dgRNA
  Gpr35
tgctgcctccgacca

SEQ ID NO: 80109 - DNA, 15 bp, Artificial Sequence
  dgRNA
  Sys1
aaaatctccctctag

SEQ ID NO: 80110 - DNA, 15 bp, Artificial Sequence
  dgRNA
  Sys1
aaatctccctctaga

SEQ ID NO: 80111 - DNA, 15 bp, Artificial Sequence
  dgRNA
  Sys1
ggcgcgcaagaccca

SEQ ID NO: 80112 - DNA, 15 bp, Artificial Sequence
  dgRNA
  Sys1
tccgggctgctcgca

SEQ ID NO: 80113 - DNA, 15 bp, Artificial Sequence
  dgRNA
  Fam71a
gatgccatttcatgt

SEQ ID NO: 80114 - DNA, 15 bp, Artificial Sequence
  dgRNA
  Fam71a
atgttggtaccctcc

SEQ ID NO: 80115 - DNA, 15 bp, Artificial Sequence
  dgRNA
  Fam71a
agcgacaggtcacaa

SEQ ID NO: 80116 - DNA, 15 bp, Artificial Sequence
  dgRNA
  Fam71a
gcgacaggtcacaaa

SEQ ID NO: 80117 - DNA, 15 bp, Artificial Sequence
  dgRNA
  Ppp6r2
aagtgagagccccta

SEQ ID NO: 80118 - DNA, 15 bp, Artificial Sequence
  dgRNA
  Ppp6r2
caagcactgtagtgg

SEQ ID NO: 80119 - DNA, 15 bp, Artificial Sequence
  dgRNA
  Ppp6r2
ggtaggtcagataag

SEQ ID NO: 80120 - DNA, 15 bp, Artificial Sequence
  dgRNA
  Ppp6r2
agccccttggacttt

SEQ ID NO: 80121 - DNA, 15 bp, Artificial Sequence
  dgRNA
  Prss55
aatttctggtacagc

SEQ ID NO: 80122 - DNA, 15 bp, Artificial Sequence
  dgRNA
  Prss55
ctgccgatgtcataa

SEQ ID NO: 80123 - DNA, 15 bp, Artificial Sequence
  dgRNA
  Prss55
tcagactccctaagc

SEQ ID NO: 80124 - DNA, 15 bp, Artificial Sequence
  dgRNA
  Gorasp2
gtcttgtctgctccg

SEQ ID NO: 80125 - DNA, 15 bp, Artificial Sequence
  dgRNA
  Gorasp2
cgagccgtcgcgttc

SEQ ID NO: 80126 - DNA, 15 bp, Artificial Sequence
  dgRNA
  Gorasp2
gagccgtcgcgttcc

SEQ ID NO: 80127 - DNA, 15 bp, Artificial Sequence
  dgRNA
  Gorasp2
tccgatcgttccctc

SEQ ID NO: 80128 - DNA, 15 bp, Artificial Sequence
  dgRNA
  Yipf5
cctccactgttaacc

SEQ ID NO: 80129 - DNA, 15 bp, Artificial Sequence
  dgRNA
  Yipf5
tgttaacccggctgc

SEQ ID NO: 80130 - DNA, 15 bp, Artificial Sequence
  dgRNA
  Yipf5
ccggctgccggaagc

SEQ ID NO: 80131 - DNA, 15 bp, Artificial Sequence
  dgRNA
  Yipf5
ttccccgttccctat

SEQ ID NO: 80132 - DNA, 15 bp, Artificial Sequence
  dgRNA
  Gbp3
tccagtcgtcgcctt

SEQ ID NO: 80133 - DNA, 15 bp, Artificial Sequence
  dgRNA
  Gbp3
gccaaaggcgacgac

SEQ ID NO: 80134 - DNA, 15 bp, Artificial Sequence
  dgRNA
  Mgl2
tgggacggcacactc

SEQ ID NO: 80135 - DNA, 15 bp, Artificial Sequence
  dgRNA
  Mgl2
caagtcactcagtat

SEQ ID NO: 80136 - DNA, 15 bp, Artificial Sequence
  dgRNA
  Mgl2
tggacgttccccaaa

SEQ ID NO: 80137 - DNA, 15 bp, Artificial Sequence
  dgRNA
  Mgl2
ggagaacagaccatt

SEQ ID NO: 80138 - DNA, 15 bp, Artificial Sequence
  dgRNA
  Ifitm6
gatcttacaccacaa

SEQ ID NO: 80139 - DNA, 15 bp, Artificial Sequence
  dgRNA
  Ifitm6
caaggaagttcatat

SEQ ID NO: 80140 - DNA, 15 bp, Artificial Sequence
  dgRNA
  Olfr701
ctcattacaccaatg

SEQ ID NO: 80141 - DNA, 15 bp, Artificial Sequence
  dgRNA
  Olfr701
attacaccaatgagg

SEQ ID NO: 80142 - DNA, 15 bp, Artificial Sequence
  dgRNA
  Olfr701
gggccatgccctcca

SEQ ID NO: 80143 - DNA, 15 bp, Artificial Sequence
  dgRNA
  Vrk3
cccgaaaattccatt

SEQ ID NO: 80144 - DNA, 15 bp, Artificial Sequence
  dgRNA
  Vrk3
aggacctttgattgg

SEQ ID NO: 80145 - DNA, 15 bp, Artificial Sequence
  dgRNA
  Vrk3
ctataacagggtagt

SEQ ID NO: 80146 - DNA, 15 bp, Artificial Sequence
  dgRNA
  Vrk3
cctataacagggtag

SEQ ID NO: 80147 - DNA, 15 bp, Artificial Sequence
  dgRNA
  Pdpk1
ggcgggcgcaggatg

SEQ ID NO: 80148 - DNA, 15 bp, Artificial Sequence
  dgRNA
  Pdpk1
gcgggcgcaggatga

SEQ ID NO: 80149 - DNA, 15 bp, Artificial Sequence
  dgRNA
  Stx19
aggttatgtagacta

SEQ ID NO: 80150 - DNA, 15 bp, Artificial Sequence
  dgRNA
  Stx19
cttgtagctagacaa

SEQ ID NO: 80151 - DNA, 15 bp, Artificial Sequence
  dgRNA
  Stx19
cggctccttggtaac

SEQ ID NO: 80152 - DNA, 15 bp, Artificial Sequence
  dgRNA
  Stx19
tttcacgcggctcct

SEQ ID NO: 80153 - DNA, 15 bp, Artificial Sequence
  dgRNA
  Zfp648
gttcgcgagcacagc

SEQ ID NO: 80154 - DNA, 15 bp, Artificial Sequence
  dgRNA
  Zfp648
ttcgcgagcacagca

SEQ ID NO: 80155 - DNA, 15 bp, Artificial Sequence
  dgRNA
  Zfp648
gaaggcggggaaccg

SEQ ID NO: 80156 - DNA, 15 bp, Artificial Sequence
  dgRNA
  Zfp648
aaggcggggaaccga

SEQ ID NO: 80157 - DNA, 15 bp, Artificial Sequence
  dgRNA
  Rcan2
acccagaagggcgac

SEQ ID NO: 80158 - DNA, 15 bp, Artificial Sequence
  dgRNA
  Rcan2
gaagggcgactggtc

SEQ ID NO: 80159 - DNA, 15 bp, Artificial Sequence
  dgRNA
  Rcan2
gggcgactggtcagg

SEQ ID NO: 80160 - DNA, 15 bp, Artificial Sequence
  dgRNA
  Rcan2
ggcgactggtcagga

SEQ ID NO: 80161 - DNA, 15 bp, Artificial Sequence
  dgRNA
  Samsn1
caaataattacggta

SEQ ID NO: 80162 - DNA, 15 bp, Artificial Sequence
  dgRNA
  Samsn1
tcacatcctgaccag

SEQ ID NO: 80163 - DNA, 15 bp, Artificial Sequence
  dgRNA
  Samsn1
ttactaagggtgtaa

SEQ ID NO: 80164 - DNA, 15 bp, Artificial Sequence
  dgRNA
  Samsn1
tacggtaattactaa

SEQ ID NO: 80165 - DNA, 15 bp, Artificial Sequence
  dgRNA
  Rragb
ccgcaggccgcccta

SEQ ID NO: 80166 - DNA, 15 bp, Artificial Sequence
  dgRNA
  Rragb
cgcaggccgccctaa

SEQ ID NO: 80167 - DNA, 15 bp, Artificial Sequence
  dgRNA
  Rragb
cgccctaagggccaa

SEQ ID NO: 80168 - DNA, 15 bp, Artificial Sequence
  dgRNA
  Rragb
taagggccaatggcg

SEQ ID NO: 80169 - DNA, 15 bp, Artificial Sequence
  dgRNA
  Hist1h2an
tggcgtagcgcccaa

SEQ ID NO: 80170 - DNA, 15 bp, Artificial Sequence
  dgRNA
  Hist1h2an
aatggaactacgctt

SEQ ID NO: 80171 - DNA, 15 bp, Artificial Sequence
  dgRNA
  Hist1h2an
ataaacgcctcccat

SEQ ID NO: 80172 - DNA, 15 bp, Artificial Sequence
  dgRNA
  Hist1h2an
gccagccaatcgcgt

SEQ ID NO: 80173 - DNA, 15 bp, Artificial Sequence
  dgRNA
  Slc36a1
gcatgccgacttccc

SEQ ID NO: 80174 - DNA, 15 bp, Artificial Sequence
  dgRNA
  Slc36a1
cggctgacggccgcc

SEQ ID NO: 80175 - DNA, 15 bp, Artificial Sequence
  dgRNA
  Slc36a1
ggcgctgcagaacaa

SEQ ID NO: 80176 - DNA, 15 bp, Artificial Sequence
  dgRNA
  Slc36a1
gaacaagggtccggg

SEQ ID NO: 80177 - DNA, 15 bp, Artificial Sequence
  dgRNA
  Timm17a
gtttatcccaggcca

SEQ ID NO: 80178 - DNA, 15 bp, Artificial Sequence
  dgRNA
  Timm17a
ttatcccaggccacg

SEQ ID NO: 80179 - DNA, 15 bp, Artificial Sequence
  dgRNA
  Timm17a
cgaacctccacgccc

SEQ ID NO: 80180 - DNA, 15 bp, Artificial Sequence
  dgRNA
  Timm17a
cctccacgccctggc

SEQ ID NO: 80181 - DNA, 15 bp, Artificial Sequence
  dgRNA
  Smarcd1
cacaccgcttctcta

SEQ ID NO: 80182 - DNA, 15 bp, Artificial Sequence
  dgRNA
  Smarcd1
cctcctggcccgtga

SEQ ID NO: 80183 - DNA, 15 bp, Artificial Sequence
  dgRNA
  Smarcd1
cctggcccgtgaagg

SEQ ID NO: 80184 - DNA, 15 bp, Artificial Sequence
  dgRNA
  Smarcd1
ctggcccgtgaaggc

SEQ ID NO: 80185 - DNA, 15 bp, Artificial Sequence
  dgRNA
  Kctd20
caccgtgaaagagct

SEQ ID NO: 80186 - DNA, 15 bp, Artificial Sequence
  dgRNA
  Kctd20
tgacgttctaattca

SEQ ID NO: 80187 - DNA, 15 bp, Artificial Sequence
  dgRNA
  Scn9a
tcaagccacataaag

SEQ ID NO: 80188 - DNA, 15 bp, Artificial Sequence
  dgRNA
  Scn9a
acattagcactgaac

SEQ ID NO: 80189 - DNA, 15 bp, Artificial Sequence
  dgRNA
  Scn9a
tagcactgaactgga

SEQ ID NO: 80190 - DNA, 15 bp, Artificial Sequence
  dgRNA
  Scn9a
ggcgaggtgatggaa

SEQ ID NO: 80191 - DNA, 15 bp, Artificial Sequence
  dgRNA
  Hsd17b4
taatcacacggacct

SEQ ID NO: 80192 - DNA, 15 bp, Artificial Sequence
  dgRNA
  Hsd17b4
caaggagactcgtac

SEQ ID NO: 80193 - DNA, 15 bp, Artificial Sequence
  dgRNA
  Hsd17b4
gtccgtgtgattaaa

SEQ ID NO: 80194 - DNA, 15 bp, Artificial Sequence
  dgRNA
  Hsd17b4
ccaagagaattgcct

SEQ ID NO: 80195 - DNA, 15 bp, Artificial Sequence
  dgRNA
  Pdgfb
ggccggaacagctga

SEQ ID NO: 80196 - DNA, 15 bp, Artificial Sequence
  dgRNA
  Pdgfb
gccggaacagctgaa

SEQ ID NO: 80197 - DNA, 15 bp, Artificial Sequence
  dgRNA
  Pdgfb
acgcgcaaaagggaa

SEQ ID NO: 80198 - DNA, 15 bp, Artificial Sequence
  dgRNA
  Pdgfb
cgcaaaagggaaagg

SEQ ID NO: 80199 - DNA, 15 bp, Artificial Sequence
  dgRNA
  Cldn34c1
gctgttgtcagagcg

SEQ ID NO: 80200 - DNA, 15 bp, Artificial Sequence
  dgRNA
  Cldn34c1
ctgttgtcagagcgc

SEQ ID NO: 80201 - DNA, 15 bp, Artificial Sequence
  dgRNA
  Cldn34c1
gcgcgggacacagtg

SEQ ID NO: 80202 - DNA, 15 bp, Artificial Sequence
  dgRNA
  Cldn34c1
cgcgggacacagtga

SEQ ID NO: 80203 - DNA, 15 bp, Artificial Sequence
  dgRNA
  Spag11b
gggtccacggtgggt

SEQ ID NO: 80204 - DNA, 15 bp, Artificial Sequence
  dgRNA
  Spag11b
tgaagggtccacggt

SEQ ID NO: 80205 - DNA, 15 bp, Artificial Sequence
  dgRNA
  Rad51ap1
ccaggatggcgtgcc

SEQ ID NO: 80206 - DNA, 15 bp, Artificial Sequence
  dgRNA
  Rad51ap1
caggatggcgtgccc

SEQ ID NO: 80207 - DNA, 15 bp, Artificial Sequence
  dgRNA
  Rad51ap1
ggcgtgcccgggcca

SEQ ID NO: 80208 - DNA, 15 bp, Artificial Sequence
  dgRNA
  Rad51ap1
acggtgtgtgtgcgc

SEQ ID NO: 80209 - DNA, 15 bp, Artificial Sequence
  dgRNA
  Slc35a5
tgcgcgcgcagcccc

SEQ ID NO: 80210 - DNA, 15 bp, Artificial Sequence
  dgRNA
  Slc35a5
tgactcgactctccc

SEQ ID NO: 80211 - DNA, 15 bp, Artificial Sequence
  dgRNA
  Slc35a5
acacgtgacaaaagg

SEQ ID NO: 80212 - DNA, 15 bp, Artificial Sequence
  dgRNA
  Slc35a5
acaaaaggaggcccg

SEQ ID NO: 80213 - DNA, 15 bp, Artificial Sequence
  dgRNA
  Slc1a2
ccactcagactcgag

SEQ ID NO: 80214 - DNA, 15 bp, Artificial Sequence
  dgRNA
  Slc1a2
cgactccttagaccc

SEQ ID NO: 80215 - DNA, 15 bp, Artificial Sequence
  dgRNA
  Slc1a2
gactccttagaccct

SEQ ID NO: 80216 - DNA, 15 bp, Artificial Sequence
  dgRNA
  Slc1a2
gccttcccggactac

SEQ ID NO: 80217 - DNA, 15 bp, Artificial Sequence
  dgRNA
  Brd1
ccctaacacccttcc

SEQ ID NO: 80218 - DNA, 15 bp, Artificial Sequence
  dgRNA
  Brd1
cccgcccccttatcc

SEQ ID NO: 80219 - DNA, 15 bp, Artificial Sequence
  dgRNA
  Brd1
ccccttatcccggct

SEQ ID NO: 80220 - DNA, 15 bp, Artificial Sequence
  dgRNA
  Brd1
tatcccggcttggcg

SEQ ID NO: 80221 - DNA, 15 bp, Artificial Sequence
  dgRNA
  Foxc1
cgggccggcagagct

SEQ ID NO: 80222 - DNA, 15 bp, Artificial Sequence
  dgRNA
  Foxc1
gcagagctcggccgc

SEQ ID NO: 80223 - DNA, 15 bp, Artificial Sequence
  dgRNA
  Foxc1
tctctcgcctcccat

SEQ ID NO: 80224 - DNA, 15 bp, Artificial Sequence
  dgRNA
  Foxc1
ctgccgcctccgtag

SEQ ID NO: 80225 - DNA, 15 bp, Artificial Sequence
  dgRNA
  Top3b
ctccggatgattttt

SEQ ID NO: 80226 - DNA, 15 bp, Artificial Sequence
  dgRNA
  Top3b
ccttagtgtcgacat

SEQ ID NO: 80227 - DNA, 15 bp, Artificial Sequence
  dgRNA
  Top3b
tagtgtcgacatcgg

SEQ ID NO: 80228 - DNA, 15 bp, Artificial Sequence
  dgRNA
  Top3b
agtgtcgacatcgga

SEQ ID NO: 80229 - DNA, 15 bp, Artificial Sequence
  dgRNA
  Nxph2
cgtgcgccctgcgct

SEQ ID NO: 80230 - DNA, 15 bp, Artificial Sequence
  dgRNA
  Nxph2
taacagcgcctatgc

SEQ ID NO: 80231 - DNA, 15 bp, Artificial Sequence
  dgRNA
  Nxph2
aacagcgcctatgct

SEQ ID NO: 80232 - DNA, 15 bp, Artificial Sequence
  dgRNA
  Nxph2
agcgcctatgctggg

SEQ ID NO: 80233 - DNA, 15 bp, Artificial Sequence
  dgRNA
  Prkacb
ctgatactaatatgc

SEQ ID NO: 80234 - DNA, 15 bp, Artificial Sequence
  dgRNA
  Prkacb
tgcaatatctgctaa

SEQ ID NO: 80235 - DNA, 15 bp, Artificial Sequence
  dgRNA
  Prkacb
tgcaaaccactactg

SEQ ID NO: 80236 - DNA, 15 bp, Artificial Sequence
  dgRNA
  Abl2
tgagcaagggtcggc

SEQ ID NO: 80237 - DNA, 15 bp, Artificial Sequence
  dgRNA
  Abl2
gagcaagggtcggcg

SEQ ID NO: 80238 - DNA, 15 bp, Artificial Sequence
  dgRNA
  Abl2
agcaagggtcggcgg

SEQ ID NO: 80239 - DNA, 15 bp, Artificial Sequence
  dgRNA
  Abl2
gcgggagtacgcgag

SEQ ID NO: 80240 - DNA, 15 bp, Artificial Sequence
  dgRNA
  Padi4
tgggcctccggggca

SEQ ID NO: 80241 - DNA, 15 bp, Artificial Sequence
  dgRNA
  Padi4
tcggaagcctgtgag

SEQ ID NO: 80242 - DNA, 15 bp, Artificial Sequence
  dgRNA
  Padi4
actcggaagcctgtg

SEQ ID NO: 80243 - DNA, 15 bp, Artificial Sequence
  dgRNA
  Enpp1
agtccagtcctcgtt

SEQ ID NO: 80244 - DNA, 15 bp, Artificial Sequence
  dgRNA
  Enpp1
cctcgttgggctacg

SEQ ID NO: 80245 - DNA, 15 bp, Artificial Sequence
  dgRNA
  Enpp1
ctcgttgggctacgc

SEQ ID NO: 80246 - DNA, 15 bp, Artificial Sequence
  dgRNA
  Enpp1
tcgttgggctacgcg

SEQ ID NO: 80247 - DNA, 15 bp, Artificial Sequence
  dgRNA
  Ngrn
tacaaggccctagct

SEQ ID NO: 80248 - DNA, 15 bp, Artificial Sequence
  dgRNA
  Ngrn
ggaaacgaaaagcgt

SEQ ID NO: 80249 - DNA, 15 bp, Artificial Sequence
  dgRNA
  Ngrn
ataccgtctaacttc

SEQ ID NO: 80250 - DNA, 15 bp, Artificial Sequence
  dgRNA
  Ngrn
cgtttcctgggtggg

SEQ ID NO: 80251 - DNA, 15 bp, Artificial Sequence
  dgRNA
  Tmem198
ctagccgtcagctag

SEQ ID NO: 80252 - DNA, 15 bp, Artificial Sequence
  dgRNA
  Tmem198
cgtcagctagcggag

SEQ ID NO: 80253 - DNA, 15 bp, Artificial Sequence
  dgRNA
  Tmem198
gtcagctagcggaga

SEQ ID NO: 80254 - DNA, 15 bp, Artificial Sequence
  dgRNA
  Tmem198
gcggagagggacgaa

SEQ ID NO: 80255 - DNA, 15 bp, Artificial Sequence
  dgRNA
  Olfr1505
cttctacaaatacgc

SEQ ID NO: 80256 - DNA, 15 bp, Artificial Sequence
  dgRNA
  Olfr1505
ttctacaaatacgca

SEQ ID NO: 80257 - DNA, 15 bp, Artificial Sequence
  dgRNA
  Olfr1505
aggcatatactcctc

SEQ ID NO: 80258 - DNA, 15 bp, Artificial Sequence
  dgRNA
  Zfp61
tgttcatgcatgcgt

SEQ ID NO: 80259 - DNA, 15 bp, Artificial Sequence
  dgRNA
  Jade1
gtttgcgggctccag

SEQ ID NO: 80260 - DNA, 15 bp, Artificial Sequence
  dgRNA
  Jade1
tgcgggctccagagg

SEQ ID NO: 80261 - DNA, 15 bp, Artificial Sequence
  dgRNA
  Jade1
gcgggctccagaggt

SEQ ID NO: 80262 - DNA, 15 bp, Artificial Sequence
  dgRNA
  Jade1
gaccccaagagttaa

SEQ ID NO: 80263 - DNA, 15 bp, Artificial Sequence
  dgRNA
  Prkag2
gccctattctcccct

SEQ ID NO: 80264 - DNA, 15 bp, Artificial Sequence
  dgRNA
  Prkag2
ccctattctccccta

SEQ ID NO: 80265 - DNA, 15 bp, Artificial Sequence
  dgRNA
  Prkag2
cctattctcccctag

SEQ ID NO: 80266 - DNA, 15 bp, Artificial Sequence
  dgRNA
  Prkag2
ctggggcgcgccctt

SEQ ID NO: 80267 - DNA, 15 bp, Artificial Sequence
  dgRNA
  Fgf14
gcacttgacaatcac

SEQ ID NO: 80268 - DNA, 15 bp, Artificial Sequence
  dgRNA
  Fgf14
aagagcggaccgctg

SEQ ID NO: 80269 - DNA, 15 bp, Artificial Sequence
  dgRNA
  Fgf14
gccgcacctgcctga

SEQ ID NO: 80270 - DNA, 15 bp, Artificial Sequence
  dgRNA
  Fgf14
gagacctgcccatcg

SEQ ID NO: 80271 - DNA, 15 bp, Artificial Sequence
  dgRNA
  Zfp526
ggaaaggagcggccc

SEQ ID NO: 80272 - DNA, 15 bp, Artificial Sequence
  dgRNA
  Zfp526
cccggagaactgcgc

SEQ ID NO: 80273 - DNA, 15 bp, Artificial Sequence
  dgRNA
  Zfp526
cgcaggcgcctctcc

SEQ ID NO: 80274 - DNA, 15 bp, Artificial Sequence
  dgRNA
  Zfp526
cgcctctcctggtcc

SEQ ID NO: 80275 - DNA, 15 bp, Artificial Sequence
  dgRNA
  Olfr834
gggaatagcatgaag

SEQ ID NO: 80276 - DNA, 15 bp, Artificial Sequence
  dgRNA
  Nup85
cgccgcctgatctac

SEQ ID NO: 80277 - DNA, 15 bp, Artificial Sequence
  dgRNA
  Nup85
gccgcctgatctact

SEQ ID NO: 80278 - DNA, 15 bp, Artificial Sequence
  dgRNA
  Nup85
tccttgaggacccgt

SEQ ID NO: 80279 - DNA, 15 bp, Artificial Sequence
  dgRNA
  Nup85
tataggttagaatag

SEQ ID NO: 80280 - DNA, 15 bp, Artificial Sequence
  dgRNA
  Polr1e
ggacgcgatccagtg

SEQ ID NO: 80281 - DNA, 15 bp, Artificial Sequence
  dgRNA
  Polr1e
gacgcgatccagtga

SEQ ID NO: 80282 - DNA, 15 bp, Artificial Sequence
  dgRNA
  Polr1e
acgcgatccagtgag

SEQ ID NO: 80283 - DNA, 15 bp, Artificial Sequence
  dgRNA
  Polr1e
actgctggtgtaccc

SEQ ID NO: 80284 - DNA, 15 bp, Artificial Sequence
  dgRNA
  Olfr924
ttcaattgttatact

SEQ ID NO: 80285 - DNA, 15 bp, Artificial Sequence
  dgRNA
  Ano5
ctcctcacccgtcca

SEQ ID NO: 80286 - DNA, 15 bp, Artificial Sequence
  dgRNA
  Ano5
ccaaggcaactcgcc

SEQ ID NO: 80287 - DNA, 15 bp, Artificial Sequence
  dgRNA
  Ano5
caactcgccaggtca

SEQ ID NO: 80288 - DNA, 15 bp, Artificial Sequence
  dgRNA
  Ano5
ggtcatggcgcctcc

SEQ ID NO: 80289 - DNA, 15 bp, Artificial Sequence
  dgRNA
  Cntd1
ctaagccgtcaagcc

SEQ ID NO: 80290 - DNA, 15 bp, Artificial Sequence
  dgRNA
  Cntd1
agcccggaactcgcc

SEQ ID NO: 80291 - DNA, 15 bp, Artificial Sequence
  dgRNA
  Cntd1
ccacgtggagttttc

SEQ ID NO: 80292 - DNA, 15 bp, Artificial Sequence
  dgRNA
  Cntd1
cacgtggagttttct

SEQ ID NO: 80293 - DNA, 15 bp, Artificial Sequence
  dgRNA
  Abhd11
gctccgcccaaggcg

SEQ ID NO: 80294 - DNA, 15 bp, Artificial Sequence
  dgRNA
  Abhd11
cccaaggcgtggtca

SEQ ID NO: 80295 - DNA, 15 bp, Artificial Sequence
  dgRNA
  Abhd11
caaggagtccaattc

SEQ ID NO: 80296 - DNA, 15 bp, Artificial Sequence
  dgRNA
  Abhd11
ttgcgaaaccgtgca

SEQ ID NO: 80297 - DNA, 15 bp, Artificial Sequence
  dgRNA
  Psmb6
agcttcgctcccaga

SEQ ID NO: 80298 - DNA, 15 bp, Artificial Sequence
  dgRNA
  Psmb6
cggagcgctttacga

SEQ ID NO: 80299 - DNA, 15 bp, Artificial Sequence
  dgRNA
  Psmb6
acgacggttgctttg

SEQ ID NO: 80300 - DNA, 15 bp, Artificial Sequence
  dgRNA
  Psmb6
cgggtctaggaaggg

SEQ ID NO: 80301 - DNA, 15 bp, Artificial Sequence
  dgRNA
  Mafa
tgctgctgcgccctt

SEQ ID NO: 80302 - DNA, 15 bp, Artificial Sequence
  dgRNA
  Mafa
tgctgcgcccttcgg

SEQ ID NO: 80303 - DNA, 15 bp, Artificial Sequence
  dgRNA
  Mafa
gagcccaccgcggcc

SEQ ID NO: 80304 - DNA, 15 bp, Artificial Sequence
  dgRNA
  Mafa
agcccaccgcggccc

SEQ ID NO: 80305 - DNA, 15 bp, Artificial Sequence
  dgRNA
  Olfr117
ggttatgttttatac

SEQ ID NO: 80306 - DNA, 15 bp, Artificial Sequence
  dgRNA
  Olfr117
acatgttagataagg

SEQ ID NO: 80307 - DNA, 15 bp, Artificial Sequence
  dgRNA
  Oaz3
gttgaatatgaacct

SEQ ID NO: 80308 - DNA, 15 bp, Artificial Sequence
  dgRNA
  Oaz3
atgaaccttggttag

SEQ ID NO: 80309 - DNA, 15 bp, Artificial Sequence
  dgRNA
  Oaz3
atactgagtcgggtg

SEQ ID NO: 80310 - DNA, 15 bp, Artificial Sequence
  dgRNA
  Oaz3
gttatatactgagtc

SEQ ID NO: 80311 - DNA, 15 bp, Artificial Sequence
  dgRNA
  BC023829
ctgcttctgacgagc

SEQ ID NO: 80312 - DNA, 15 bp, Artificial Sequence
  dgRNA
  BC023829
tgcttctgacgagct

SEQ ID NO: 80313 - DNA, 15 bp, Artificial Sequence
  dgRNA
  BC023829
gcttctgacgagctg

SEQ ID NO: 80314 - DNA, 15 bp, Artificial Sequence
  dgRNA
  BC023829
tctgacgagctgggg

SEQ ID NO: 80315 - DNA, 15 bp, Artificial Sequence
  dgRNA
  A130010J15Rik
ggggcgggtctaagg

SEQ ID NO: 80316 - DNA, 15 bp, Artificial Sequence
  dgRNA
  A130010J15Rik
ccgcagcctcttcaa

SEQ ID NO: 80317 - DNA, 15 bp, Artificial Sequence
  dgRNA
  A130010J15Rik
tttcaaatgacgtca

SEQ ID NO: 80318 - DNA, 15 bp, Artificial Sequence
  dgRNA
  A130010J15Rik
gacgtcacggaaagg

SEQ ID NO: 80319 - DNA, 15 bp, Artificial Sequence
  dgRNA
  Acbd3
ccccacgggacgtcc

SEQ ID NO: 80320 - DNA, 15 bp, Artificial Sequence
  dgRNA
  Acbd3
gacgtcccggctccc

SEQ ID NO: 80321 - DNA, 15 bp, Artificial Sequence
  dgRNA
  Acbd3
acgtcccggctccct

SEQ ID NO: 80322 - DNA, 15 bp, Artificial Sequence
  dgRNA
  Acbd3
ctgggacggccacgg

SEQ ID NO: 80323 - DNA, 15 bp, Artificial Sequence
  dgRNA
  Nlgn1
atactttgaccgttt

SEQ ID NO: 80324 - DNA, 15 bp, Artificial Sequence
  dgRNA
  Nlgn1
tcggcttgaatttga

SEQ ID NO: 80325 - DNA, 15 bp, Artificial Sequence
  dgRNA
  Nlgn1
cggcttgaatttgac

SEQ ID NO: 80326 - DNA, 15 bp, Artificial Sequence
  dgRNA
  Nlgn1
tttgacgggaagtgt

SEQ ID NO: 80327 - DNA, 15 bp, Artificial Sequence
  dgRNA
  Olfr868
taatacaaattctgc

SEQ ID NO: 80328 - DNA, 15 bp, Artificial Sequence
  dgRNA
  Olfr868
gggactagtacaacc

SEQ ID NO: 80329 - DNA, 15 bp, Artificial Sequence
  dgRNA
  Olfr868
tatacaaatgggacc

SEQ ID NO: 80330 - DNA, 15 bp, Artificial Sequence
  dgRNA
  Olfr868
attctatggtcttga

SEQ ID NO: 80331 - DNA, 15 bp, Artificial Sequence
  dgRNA
  Shq1
agtccgtaaacgtcc

SEQ ID NO: 80332 - DNA, 15 bp, Artificial Sequence
  dgRNA
  Shq1
tcataacaagcctgc

SEQ ID NO: 80333 - DNA, 15 bp, Artificial Sequence
  dgRNA
  Shq1
agcgtcccgtctcca

SEQ ID NO: 80334 - DNA, 15 bp, Artificial Sequence
  dgRNA
  Shq1
caaggagactggcgc

SEQ ID NO: 80335 - DNA, 15 bp, Artificial Sequence
  dgRNA
  Cnr2
ccttgccctagaaat

SEQ ID NO: 80336 - DNA, 15 bp, Artificial Sequence
  dgRNA
  Cnr2
gtatctctatcttcg

SEQ ID NO: 80337 - DNA, 15 bp, Artificial Sequence
  dgRNA
  Cnr2
ataagtagctgctct

SEQ ID NO: 80338 - DNA, 15 bp, Artificial Sequence
  dgRNA
  Cnr2
tataagtagctgctc

SEQ ID NO: 80339 - DNA, 15 bp, Artificial Sequence
  dgRNA
  Edc4
aaaccctaccatctc

SEQ ID NO: 80340 - DNA, 15 bp, Artificial Sequence
  dgRNA
  Atg4b
acggcgccggcgtcg

SEQ ID NO: 80341 - DNA, 15 bp, Artificial Sequence
  dgRNA
  Atg4b
gcgtcgcggccgcag

SEQ ID NO: 80342 - DNA, 15 bp, Artificial Sequence
  dgRNA
  Atg4b
cgtcgcggccgcagc

SEQ ID NO: 80343 - DNA, 15 bp, Artificial Sequence
  dgRNA
  Atg4b
gtaccgagacatgcg

SEQ ID NO: 80344 - DNA, 15 bp, Artificial Sequence
  dgRNA
  Cd209g
cacatgtactgtaac

SEQ ID NO: 80345 - DNA, 15 bp, Artificial Sequence
  dgRNA
  Tmem158
ctccgggactcgctc

SEQ ID NO: 80346 - DNA, 15 bp, Artificial Sequence
  dgRNA
  Tmem158
tccgggactcgctct

SEQ ID NO: 80347 - DNA, 15 bp, Artificial Sequence
  dgRNA
  Tmem158
tgggcttcccgccct

SEQ ID NO: 80348 - DNA, 15 bp, Artificial Sequence
  dgRNA
  Tmem158
gggcttcccgccctc

SEQ ID NO: 80349 - DNA, 15 bp, Artificial Sequence
  dgRNA
  Mars2
ccaactgccctgaca

SEQ ID NO: 80350 - DNA, 15 bp, Artificial Sequence
  dgRNA
  Mars2
ctcaaaaactcccgc

SEQ ID NO: 80351 - DNA, 15 bp, Artificial Sequence
  dgRNA
  Mars2
gcccctgcgcgctgc

SEQ ID NO: 80352 - DNA, 15 bp, Artificial Sequence
  dgRNA
  Mars2
cgcgctgcaggaaac

SEQ ID NO: 80353 - DNA, 15 bp, Artificial Sequence
  dgRNA
  Tgfbr3l
gtttggagtgaccga

SEQ ID NO: 80354 - DNA, 15 bp, Artificial Sequence
  dgRNA
  Tgfbr3l
gtgaccgaaggcatc

SEQ ID NO: 80355 - DNA, 15 bp, Artificial Sequence
  dgRNA
  Tgfbr3l
gaaagcccttatcca

SEQ ID NO: 80356 - DNA, 15 bp, Artificial Sequence
  dgRNA
  Tgfbr3l
gcccttatccatggc

SEQ ID NO: 80357 - DNA, 15 bp, Artificial Sequence
  dgRNA
  Cops7b
ccctagaatcaccaa

SEQ ID NO: 80358 - DNA, 15 bp, Artificial Sequence
  dgRNA
  Cops7b
tttgcctcccgtttc

SEQ ID NO: 80359 - DNA, 15 bp, Artificial Sequence
  dgRNA
  Cops7b
cagcctcaatctagg

SEQ ID NO: 80360 - DNA, 15 bp, Artificial Sequence
  dgRNA
  Cops7b
agcctcaatctaggt

SEQ ID NO: 80361 - DNA, 15 bp, Artificial Sequence
  dgRNA
  Npb
agttccacttgaggg

SEQ ID NO: 80362 - DNA, 15 bp, Artificial Sequence
  dgRNA
  Npb
tctgccccatctcgc

SEQ ID NO: 80363 - DNA, 15 bp, Artificial Sequence
  dgRNA
  Npb
ctgccccatctcgca

SEQ ID NO: 80364 - DNA, 15 bp, Artificial Sequence
  dgRNA
  Npb
cgttcctccctcaag

SEQ ID NO: 80365 - DNA, 15 bp, Artificial Sequence
  dgRNA
  Kansl3
agaacgtctctgccc

SEQ ID NO: 80366 - DNA, 15 bp, Artificial Sequence
  dgRNA
  Kansl3
gaacgtctctgcccc

SEQ ID NO: 80367 - DNA, 15 bp, Artificial Sequence
  dgRNA
  Kansl3
ttccgcgttccccac

SEQ ID NO: 80368 - DNA, 15 bp, Artificial Sequence
  dgRNA
  Kansl3
aggttagccaggtcc

SEQ ID NO: 80369 - DNA, 15 bp, Artificial Sequence
  dgRNA
  Gm14325
ggcaggtcaacgtgg

SEQ ID NO: 80370 - DNA, 15 bp, Artificial Sequence
  dgRNA
  Gm14325
actggcaggtcaacg

SEQ ID NO: 80371 - DNA, 15 bp, Artificial Sequence
  dgRNA
  9330159F19Rik
gagttgtttacccag

SEQ ID NO: 80372 - DNA, 15 bp, Artificial Sequence
  dgRNA
  9330159F19Rik
tgggtaaacaactcc

SEQ ID NO: 80373 - DNA, 15 bp, Artificial Sequence
  dgRNA
  9330159F19Rik
gcagttatatcctct

SEQ ID NO: 80374 - DNA, 15 bp, Artificial Sequence
  dgRNA
  9330159F19Rik
agcagttatatcctc

SEQ ID NO: 80375 - DNA, 15 bp, Artificial Sequence
  dgRNA
  Nck1
gcgcagtctcagctc

SEQ ID NO: 80376 - DNA, 15 bp, Artificial Sequence
  dgRNA
  Nck1
cgcagtctcagctca

SEQ ID NO: 80377 - DNA, 15 bp, Artificial Sequence
  dgRNA
  Nck1
ccgctcgcccaatcc

SEQ ID NO: 80378 - DNA, 15 bp, Artificial Sequence
  dgRNA
  Nck1
cgcccaatcccggag

SEQ ID NO: 80379 - DNA, 15 bp, Artificial Sequence
  dgRNA
  Smurf2
gcaccgtccgctccc

SEQ ID NO: 80380 - DNA, 15 bp, Artificial Sequence
  dgRNA
  Smurf2
cgctcccaggcctcg

SEQ ID NO: 80381 - DNA, 15 bp, Artificial Sequence
  dgRNA
  Smurf2
ctcgcggcaccgaga

SEQ ID NO: 80382 - DNA, 15 bp, Artificial Sequence
  dgRNA
  Smurf2
tcgcggcaccgagaa

SEQ ID NO: 80383 - DNA, 15 bp, Artificial Sequence
  dgRNA
  Zbtb39
aggcgccacagcgag

SEQ ID NO: 80384 - DNA, 15 bp, Artificial Sequence
  dgRNA
  Zbtb39
ggcgccacagcgagc

SEQ ID NO: 80385 - DNA, 15 bp, Artificial Sequence
  dgRNA
  Zbtb39
ccacagcgagcgggc

SEQ ID NO: 80386 - DNA, 15 bp, Artificial Sequence
  dgRNA
  Zbtb39
gcgagcgggctggtg

SEQ ID NO: 80387 - DNA, 15 bp, Artificial Sequence
  dgRNA
  Olfr62
cgtgtttggcacacc

SEQ ID NO: 80388 - DNA, 15 bp, Artificial Sequence
  dgRNA
  Olfr62
cacctggtgcacgaa

SEQ ID NO: 80389 - DNA, 15 bp, Artificial Sequence
  dgRNA
  Olfr62
gcaaagttagcacct

SEQ ID NO: 80390 - DNA, 15 bp, Artificial Sequence
  dgRNA
  Olfr62
agtcaagtacatatc

SEQ ID NO: 80391 - DNA, 15 bp, Artificial Sequence
  dgRNA
  Mcam
agagtctacagcgac

SEQ ID NO: 80392 - DNA, 15 bp, Artificial Sequence
  dgRNA
  Mcam
gagtctacagcgacc

SEQ ID NO: 80393 - DNA, 15 bp, Artificial Sequence
  dgRNA
  Mcam
agtcattcgagcccc

SEQ ID NO: 80394 - DNA, 15 bp, Artificial Sequence
  dgRNA
  Mcam
cgggagttagcctct

SEQ ID NO: 80395 - DNA, 15 bp, Artificial Sequence
  dgRNA
  Smarce1
ggtatgccagctgga

SEQ ID NO: 80396 - DNA, 15 bp, Artificial Sequence
  dgRNA
  Smarce1
gggtttctgcgccta

SEQ ID NO: 80397 - DNA, 15 bp, Artificial Sequence
  dgRNA
  Smarce1
cgggtttctgcgcct

SEQ ID NO: 80398 - DNA, 15 bp, Artificial Sequence
  dgRNA
  Smarce1
tcgagtgatggcggc

SEQ ID NO: 80399 - DNA, 15 bp, Artificial Sequence
  dgRNA
  Chaf1b
cagagctccgcccac

SEQ ID NO: 80400 - DNA, 15 bp, Artificial Sequence
  dgRNA
  Chaf1b
gcccaccggaagcca

SEQ ID NO: 80401 - DNA, 15 bp, Artificial Sequence
  dgRNA
  Chaf1b
cggaagccaaggtgc

SEQ ID NO: 80402 - DNA, 15 bp, Artificial Sequence
  dgRNA
  Chaf1b
gtgccgggagattgc

SEQ ID NO: 80403 - DNA, 15 bp, Artificial Sequence
  dgRNA
  Asun
ctgctcacacagcgg

SEQ ID NO: 80404 - DNA, 15 bp, Artificial Sequence
  dgRNA
  Asun
cagcggcgggacgta

SEQ ID NO: 80405 - DNA, 15 bp, Artificial Sequence
  dgRNA
  Asun
agcggcgggacgtac

SEQ ID NO: 80406 - DNA, 15 bp, Artificial Sequence
  dgRNA
  Asun
gaaacccactcgtct

SEQ ID NO: 80407 - DNA, 15 bp, Artificial Sequence
  dgRNA
  Pnpla8
ttgccccttccgaag

SEQ ID NO: 80408 - DNA, 15 bp, Artificial Sequence
  dgRNA
  Pnpla8
cacgccctattacgt

SEQ ID NO: 80409 - DNA, 15 bp, Artificial Sequence
  dgRNA
  Pnpla8
ctattacgtaggctt

SEQ ID NO: 80410 - DNA, 15 bp, Artificial Sequence
  dgRNA
  Pnpla8
ttacgtaggcttagg

SEQ ID NO: 80411 - DNA, 15 bp, Artificial Sequence
  dgRNA
  Zar1l
taggtgacttcaatt

SEQ ID NO: 80412 - DNA, 15 bp, Artificial Sequence
  dgRNA
  Zar1l
aggtgacttcaatta

SEQ ID NO: 80413 - DNA, 15 bp, Artificial Sequence
  dgRNA
  Zar1l
aattagggagctaac

SEQ ID NO: 80414 - DNA, 15 bp, Artificial Sequence
  dgRNA
  Zar1l
tggctgctcccgctc

SEQ ID NO: 80415 - DNA, 15 bp, Artificial Sequence
  dgRNA
  Slc31a1
gctcccagtgacgca

SEQ ID NO: 80416 - DNA, 15 bp, Artificial Sequence
  dgRNA
  Slc31a1
accagccctccgagg

SEQ ID NO: 80417 - DNA, 15 bp, Artificial Sequence
  dgRNA
  Slc31a1
gttctgagcggtgat

SEQ ID NO: 80418 - DNA, 15 bp, Artificial Sequence
  dgRNA
  Slc31a1
ctgagcggtgattgg

SEQ ID NO: 80419 - DNA, 15 bp, Artificial Sequence
  dgRNA
  Gm7257
taacaccatgacgtt

SEQ ID NO: 80420 - DNA, 15 bp, Artificial Sequence
  dgRNA
  Gm7257
tatctatgccccccc

SEQ ID NO: 80421 - DNA, 15 bp, Artificial Sequence
  dgRNA
  Gm7257
tgctcagtcaatttc

SEQ ID NO: 80422 - DNA, 15 bp, Artificial Sequence
  dgRNA
  Gm7257
gctcagtcaatttct

SEQ ID NO: 80423 - DNA, 15 bp, Artificial Sequence
  dgRNA
  Aadat
tcagctgccataggc

SEQ ID NO: 80424 - DNA, 15 bp, Artificial Sequence
  dgRNA
  Aadat
ctgccataggccggc

SEQ ID NO: 80425 - DNA, 15 bp, Artificial Sequence
  dgRNA
  Aadat
ccataggccggccgg

SEQ ID NO: 80426 - DNA, 15 bp, Artificial Sequence
  dgRNA
  Aadat
cataggccggccggc

SEQ ID NO: 80427 - DNA, 15 bp, Artificial Sequence
  dgRNA
  Tnni1
ctggccagttgccgg

SEQ ID NO: 80428 - DNA, 15 bp, Artificial Sequence
  dgRNA
  Tnni1
cagcctagctccacg

SEQ ID NO: 80429 - DNA, 15 bp, Artificial Sequence
  dgRNA
  Tnni1
gtggcctccggcaac

SEQ ID NO: 80430 - DNA, 15 bp, Artificial Sequence
  dgRNA
  Tnni1
gaaaaccgtggcctc

SEQ ID NO: 80431 - DNA, 15 bp, Artificial Sequence
  dgRNA
  Glrx2
tacaccattagacct

SEQ ID NO: 80432 - DNA, 15 bp, Artificial Sequence
  dgRNA
  Glrx2
cagtgtatagagcta

SEQ ID NO: 80433 - DNA, 15 bp, Artificial Sequence
  dgRNA
  Glrx2
agtgtatagagctaa

SEQ ID NO: 80434 - DNA, 15 bp, Artificial Sequence
  dgRNA
  Glrx2
gtatagagctaaggg

SEQ ID NO: 80435 - DNA, 15 bp, Artificial Sequence
  dgRNA
  Qdpr
agcgcgtgtgtctcg

SEQ ID NO: 80436 - DNA, 15 bp, Artificial Sequence
  dgRNA
  Qdpr
cggcttagtttctag

SEQ ID NO: 80437 - DNA, 15 bp, Artificial Sequence
  dgRNA
  Qdpr
cttagttttagggcg

SEQ ID NO: 80438 - DNA, 15 bp, Artificial Sequence
  dgRNA
  Qdpr
gttttagggcgtgga

SEQ ID NO: 80439 - DNA, 15 bp, Artificial Sequence
  dgRNA
  Gtf2e2
cggcggcgggcgaag

SEQ ID NO: 80440 - DNA, 15 bp, Artificial Sequence
  dgRNA
  Gtf2e2
gggacgagtcccgcg

SEQ ID NO: 80441 - DNA, 15 bp, Artificial Sequence
  dgRNA
  Gtf2e2
ggacgagtcccgcgt

SEQ ID NO: 80442 - DNA, 15 bp, Artificial Sequence
  dgRNA
  Gtf2e2
gtcccgcgtgggact

SEQ ID NO: 80443 - DNA, 15 bp, Artificial Sequence
  dgRNA
  Olfr846
aacgaataaaacatt

SEQ ID NO: 80444 - DNA, 15 bp, Artificial Sequence
  dgRNA
  Olfr846
cctcatttaagatac

SEQ ID NO: 80445 - DNA, 15 bp, Artificial Sequence
  dgRNA
  Gnaq
cagccgcggcgcgcc

SEQ ID NO: 80446 - DNA, 15 bp, Artificial Sequence
  dgRNA
  Gnaq
ggcgcgcctggcaat

SEQ ID NO: 80447 - DNA, 15 bp, Artificial Sequence
  dgRNA
  Gnaq
gcgcgcctggcaatc

SEQ ID NO: 80448 - DNA, 15 bp, Artificial Sequence
  dgRNA
  Gnaq
gcctggcaatcgggc

SEQ ID NO: 80449 - DNA, 15 bp, Artificial Sequence
  dgRNA
  Ofcc1
tctggtgtcgtctta

SEQ ID NO: 80450 - DNA, 15 bp, Artificial Sequence
  dgRNA
  Ofcc1
catcgggatctaatc

SEQ ID NO: 80451 - DNA, 15 bp, Artificial Sequence
  dgRNA
  Ofcc1
tacgtggagaaattc

SEQ ID NO: 80452 - DNA, 15 bp, Artificial Sequence
  dgRNA
  Ofcc1
tgatcaaaaaatacg

SEQ ID NO: 80453 - DNA, 15 bp, Artificial Sequence
  dgRNA
  Map4k5
tttacctgtaccgaa

SEQ ID NO: 80454 - DNA, 15 bp, Artificial Sequence
  dgRNA
  Map4k5
aaggcagcgctccgg

SEQ ID NO: 80455 - DNA, 15 bp, Artificial Sequence
  dgRNA
  Map4k5
cgctccggaggcctg

SEQ ID NO: 80456 - DNA, 15 bp, Artificial Sequence
  dgRNA
  Map4k5
cctcctctagtccgc

SEQ ID NO: 80457 - DNA, 15 bp, Artificial Sequence
  dgRNA
  Mfap3l
gaataataagtaccg

SEQ ID NO: 80458 - DNA, 15 bp, Artificial Sequence
  dgRNA
  Mfap3l
aataataagtaccgg

SEQ ID NO: 80459 - DNA, 15 bp, Artificial Sequence
  dgRNA
  Mfap3l
agtaccgggggttta

SEQ ID NO: 80460 - DNA, 15 bp, Artificial Sequence
  dgRNA
  Mfap3l
tatggcctgaagcac

SEQ ID NO: 80461 - DNA, 15 bp, Artificial Sequence
  dgRNA
  Olfr1022
catattggacattat

SEQ ID NO: 80462 - DNA, 15 bp, Artificial Sequence
  dgRNA
  Olfr1022
cacagtttagatacg

SEQ ID NO: 80463 - DNA, 15 bp, Artificial Sequence
  dgRNA
  Foxe3
ggccctctcctcggg

SEQ ID NO: 80464 - DNA, 15 bp, Artificial Sequence
  dgRNA
  Foxe3
ctctcctcgggaggt

SEQ ID NO: 80465 - DNA, 15 bp, Artificial Sequence
  dgRNA
  Foxe3
gcgacccccgctctc

SEQ ID NO: 80466 - DNA, 15 bp, Artificial Sequence
  dgRNA
  Foxe3
cgacccccgctctcc

SEQ ID NO: 80467 - DNA, 15 bp, Artificial Sequence
  dgRNA
  Olfr847
acacaatgcttcatt

SEQ ID NO: 80468 - DNA, 15 bp, Artificial Sequence
  dgRNA
  Olfr847
gtaaaatcagatgta

SEQ ID NO: 80469 - DNA, 15 bp, Artificial Sequence
  dgRNA
  Cybrd1
gtaggcttgagctcc

SEQ ID NO: 80470 - DNA, 15 bp, Artificial Sequence
  dgRNA
  Cybrd1
ggcgctgtcttggtg

SEQ ID NO: 80471 - DNA, 15 bp, Artificial Sequence
  dgRNA
  Cybrd1
gactcacactcaagg

SEQ ID NO: 80472 - DNA, 15 bp, Artificial Sequence
  dgRNA
  Cybrd1
gtgcagccgcgtgat

SEQ ID NO: 80473 - DNA, 15 bp, Artificial Sequence
  dgRNA
  Vmn1r66
ggtcatagaatatga

SEQ ID NO: 80474 - DNA, 15 bp, Artificial Sequence
  dgRNA
  Vmn1r66
gacgcacatgtggat

SEQ ID NO: 80475 - DNA, 15 bp, Artificial Sequence
  dgRNA
  Vmn1r66
ttgaggacgcacatg

SEQ ID NO: 80476 - DNA, 15 bp, Artificial Sequence
  dgRNA
  Zmynd10
gtagctaccctattg

SEQ ID NO: 80477 - DNA, 15 bp, Artificial Sequence
  dgRNA
  Zmynd10
tagctaccctattga

SEQ ID NO: 80478 - DNA, 15 bp, Artificial Sequence
  dgRNA
  Zmynd10
agctaccctattgag

SEQ ID NO: 80479 - DNA, 15 bp, Artificial Sequence
  dgRNA
  Zmynd10
tgtggcgagtgggtc

SEQ ID NO: 80480 - DNA, 15 bp, Artificial Sequence
  dgRNA
  Trpc3
gtctacagatgcatg

SEQ ID NO: 80481 - DNA, 15 bp, Artificial Sequence
  dgRNA
  Trpc3
gatgcatgagggttc

SEQ ID NO: 80482 - DNA, 15 bp, Artificial Sequence
  dgRNA
  Trpc3
ggtctctggtaaaaa

SEQ ID NO: 80483 - DNA, 15 bp, Artificial Sequence
  dgRNA
  Trpc3
acagcgctgtctgcg

SEQ ID NO: 80484 - DNA, 15 bp, Artificial Sequence
  dgRNA
  Cst3
ggtatctgacctaca

SEQ ID NO: 80485 - DNA, 15 bp, Artificial Sequence
  dgRNA
  Tvp23b
agagtctctgcgtca

SEQ ID NO: 80486 - DNA, 15 bp, Artificial Sequence
  dgRNA
  Tvp23b
cccgcgtccgtcgcg

SEQ ID NO: 80487 - DNA, 15 bp, Artificial Sequence
  dgRNA
  Tvp23b
ccccgccccaaggta

SEQ ID NO: 80488 - DNA, 15 bp, Artificial Sequence
  dgRNA
  Tvp23b
gaaaagcaaaacgct

SEQ ID NO: 80489 - DNA, 15 bp, Artificial Sequence
  dgRNA
  Gm3336
gttcaccccgtgctg

SEQ ID NO: 80490 - DNA, 15 bp, Artificial Sequence
  dgRNA
  Gm3336
caccccgtgctgagg

SEQ ID NO: 80491 - DNA, 15 bp, Artificial Sequence
  dgRNA
  Gm3336
ggcgctggggtgcca

SEQ ID NO: 80492 - DNA, 15 bp, Artificial Sequence
  dgRNA
  Gm3336
gctggggtgccaagg

SEQ ID NO: 80493 - DNA, 15 bp, Artificial Sequence
  dgRNA
  Slc9a4
ccttatcagccacaa

SEQ ID NO: 80494 - DNA, 15 bp, Artificial Sequence
  dgRNA
  Slc9a4
cctgccaagaacctt

SEQ ID NO: 80495 - DNA, 15 bp, Artificial Sequence
  dgRNA
  Slc9a4
cctttgtggctgata

SEQ ID NO: 80496 - DNA, 15 bp, Artificial Sequence
  dgRNA
  Slc9a4
ccgaaggttcttggc

SEQ ID NO: 80497 - DNA, 15 bp, Artificial Sequence
  dgRNA
  Slc3a2
acgtttgttattcta

SEQ ID NO: 80498 - DNA, 15 bp, Artificial Sequence
  dgRNA
  Slc3a2
cgtttgttattctaa

SEQ ID NO: 80499 - DNA, 15 bp, Artificial Sequence
  dgRNA
  Slc3a2
gcaggaataagcgtt

SEQ ID NO: 80500 - DNA, 15 bp, Artificial Sequence
  dgRNA
  Slc3a2
caggaataagcgtta

SEQ ID NO: 80501 - DNA, 15 bp, Artificial Sequence
  dgRNA
  Ddx6
ggcggcggcgacatc

SEQ ID NO: 80502 - DNA, 15 bp, Artificial Sequence
  dgRNA
  Ddx6
gcggcggcgacatcg

SEQ ID NO: 80503 - DNA, 15 bp, Artificial Sequence
  dgRNA
  Ddx6
cggcggcgacatcgg

SEQ ID NO: 80504 - DNA, 15 bp, Artificial Sequence
  dgRNA
  Ddx6
cgacatcgggggcgc

SEQ ID NO: 80505 - DNA, 15 bp, Artificial Sequence
  dgRNA
  Hrh3
ggttattgcccgagt

SEQ ID NO: 80506 - DNA, 15 bp, Artificial Sequence
  dgRNA
  Hrh3
gttattgcccgagtc

SEQ ID NO: 80507 - DNA, 15 bp, Artificial Sequence
  dgRNA
  Hrh3
agccacggtgcgcac

SEQ ID NO: 80508 - DNA, 15 bp, Artificial Sequence
  dgRNA
  Hrh3
gccacggtgcgcacc

SEQ ID NO: 80509 - DNA, 15 bp, Artificial Sequence
  dgRNA
  A1cf
aaatcttattgaccc

SEQ ID NO: 80510 - DNA, 15 bp, Artificial Sequence
  dgRNA
  A1cf
tcttattgaccccgg

SEQ ID NO: 80511 - DNA, 15 bp, Artificial Sequence
  dgRNA
  A1cf
caattacctggtcaa

SEQ ID NO: 80512 - DNA, 15 bp, Artificial Sequence
  dgRNA
  A1cf
ggtcaaagggctgcg

SEQ ID NO: 80513 - DNA, 15 bp, Artificial Sequence
  dgRNA
  Klf1
ccgttttgctttgcc

SEQ ID NO: 80514 - DNA, 15 bp, Artificial Sequence
  dgRNA
  Klf1
cgttttgctttgcct

SEQ ID NO: 80515 - DNA, 15 bp, Artificial Sequence
  dgRNA
  Klf1
tgcctgggtcttatc

SEQ ID NO: 80516 - DNA, 15 bp, Artificial Sequence
  dgRNA
  Klf1
aaggttttcgaaaca

SEQ ID NO: 80517 - DNA, 15 bp, Artificial Sequence
  dgRNA
  Rabif
ggcgcctgggagacc

SEQ ID NO: 80518 - DNA, 15 bp, Artificial Sequence
  dgRNA
  Rabif
cctgacacttccgtc

SEQ ID NO: 80519 - DNA, 15 bp, Artificial Sequence
  dgRNA
  Rabif
tccggcaatagagaa

SEQ ID NO: 80520 - DNA, 15 bp, Artificial Sequence
  dgRNA
  Rabif
cagacgcctgcgcag

SEQ ID NO: 80521 - DNA, 15 bp, Artificial Sequence
  dgRNA
  Gfod2
ctatctacattcttg

SEQ ID NO: 80522 - DNA, 15 bp, Artificial Sequence
  dgRNA
  Gfod2
ctacattcttgaggc

SEQ ID NO: 80523 - DNA, 15 bp, Artificial Sequence
  dgRNA
  Gfod2
gagagcgcccgaagc

SEQ ID NO: 80524 - DNA, 15 bp, Artificial Sequence
  dgRNA
  Gfod2
caataggctccctga

SEQ ID NO: 80525 - DNA, 15 bp, Artificial Sequence
  dgRNA
  G6pdx
cctaccccattttca

SEQ ID NO: 80526 - DNA, 15 bp, Artificial Sequence
  dgRNA
  G6pdx
acccaagtttcagtc

SEQ ID NO: 80527 - DNA, 15 bp, Artificial Sequence
  dgRNA
  G6pdx
tctggtcctgctact

SEQ ID NO: 80528 - DNA, 15 bp, Artificial Sequence
  dgRNA
  G6pdx
gggctctctgccgct

SEQ ID NO: 80529 - DNA, 15 bp, Artificial Sequence
  dgRNA
  Myo3b
tgagctcccttagga

SEQ ID NO: 80530 - DNA, 15 bp, Artificial Sequence
  dgRNA
  Myo3b
agcggcctcaagttc

SEQ ID NO: 80531 - DNA, 15 bp, Artificial Sequence
  dgRNA
  Myo3b
tttcatcctcgtgct

SEQ ID NO: 80532 - DNA, 15 bp, Artificial Sequence
  dgRNA
  Myo3b
ttcatcctcgtgctt

SEQ ID NO: 80533 - DNA, 15 bp, Artificial Sequence
  dgRNA
  Zfp28
ccgcggttctcccac

SEQ ID NO: 80534 - DNA, 15 bp, Artificial Sequence
  dgRNA
  Zfp28
cgcggttctcccaca

SEQ ID NO: 80535 - DNA, 15 bp, Artificial Sequence
  dgRNA
  Zfp28
aaaggatttctccgc

SEQ ID NO: 80536 - DNA, 15 bp, Artificial Sequence
  dgRNA
  Zfp28
aaggatttctccgct

SEQ ID NO: 80537 - DNA, 15 bp, Artificial Sequence
  dgRNA
  Atp5g2
cggctcttccgtgca

SEQ ID NO: 80538 - DNA, 15 bp, Artificial Sequence
  dgRNA
  Atp5g2
ctcttccgtgcacgg

SEQ ID NO: 80539 - DNA, 15 bp, Artificial Sequence
  dgRNA
  Atp5g2
tcttccgtgcacggt

SEQ ID NO: 80540 - DNA, 15 bp, Artificial Sequence
  dgRNA
  Atp5g2
ctcctgttggacgcc

SEQ ID NO: 80541 - DNA, 15 bp, Artificial Sequence
  dgRNA
  Ccdc15
gtctaagctcgctgc

SEQ ID NO: 80542 - DNA, 15 bp, Artificial Sequence
  dgRNA
  Ccdc15
gtcctccccaaccaa

SEQ ID NO: 80543 - DNA, 15 bp, Artificial Sequence
  dgRNA
  Ccdc15
cgtaatccccgcgct

SEQ ID NO: 80544 - DNA, 15 bp, Artificial Sequence
  dgRNA
  Ccdc15
tctgacatgatgaac

SEQ ID NO: 80545 - DNA, 15 bp, Artificial Sequence
  dgRNA
  Cdh16
tatgtctaagcccag

SEQ ID NO: 80546 - DNA, 15 bp, Artificial Sequence
  dgRNA
  Cdh16
attgggctgtgtcaa

SEQ ID NO: 80547 - DNA, 15 bp, Artificial Sequence
  dgRNA
  Cdh16
attgttccttgtgcc

SEQ ID NO: 80548 - DNA, 15 bp, Artificial Sequence
  dgRNA
  Cdh16
ccaatgagcacttgc

SEQ ID NO: 80549 - DNA, 15 bp, Artificial Sequence
  dgRNA
  Fsd1
ctcccagtattacac

SEQ ID NO: 80550 - DNA, 15 bp, Artificial Sequence
  dgRNA
  Fsd1
tcccagtattacact

SEQ ID NO: 80551 - DNA, 15 bp, Artificial Sequence
  dgRNA
  Fsd1
ggataacccaagctc

SEQ ID NO: 80552 - DNA, 15 bp, Artificial Sequence
  dgRNA
  Fsd1
taacccaagctccgg

SEQ ID NO: 80553 - DNA, 15 bp, Artificial Sequence
  dgRNA
  Pax8
cagccagccaatccg

SEQ ID NO: 80554 - DNA, 15 bp, Artificial Sequence
  dgRNA
  Pax8
gaatcctaactcagc

SEQ ID NO: 80555 - DNA, 15 bp, Artificial Sequence
  dgRNA
  Pax8
gttagaaacattcgc

SEQ ID NO: 80556 - DNA, 15 bp, Artificial Sequence
  dgRNA
  Pax8
ggggattttgcaagg

SEQ ID NO: 80557 - DNA, 15 bp, Artificial Sequence
  dgRNA
  Eif2ak4
ccacttagatcctaa

SEQ ID NO: 80558 - DNA, 15 bp, Artificial Sequence
  dgRNA
  Eif2ak4
cctctgcgccgccac

SEQ ID NO: 80559 - DNA, 15 bp, Artificial Sequence
  dgRNA
  Eif2ak4
ccactggtcttgaga

SEQ ID NO: 80560 - DNA, 15 bp, Artificial Sequence
  dgRNA
  Eif2ak4
tcttttttccccggt

SEQ ID NO: 80561 - DNA, 15 bp, Artificial Sequence
  dgRNA
  Trappc10
cccgccctgcaccgc

SEQ ID NO: 80562 - DNA, 15 bp, Artificial Sequence
  dgRNA
  Trappc10
ccgccctgcaccgcc

SEQ ID NO: 80563 - DNA, 15 bp, Artificial Sequence
  dgRNA
  Trappc10
ccctgcaccgccggg

SEQ ID NO: 80564 - DNA, 15 bp, Artificial Sequence
  dgRNA
  Trappc10
caccgccgggcggcc

SEQ ID NO: 80565 - DNA, 15 bp, Artificial Sequence
  dgRNA
  Armc10
gcggggcaactgggg

SEQ ID NO: 80566 - DNA, 15 bp, Artificial Sequence
  dgRNA
  Armc10
cggggcaactggggc

SEQ ID NO: 80567 - DNA, 15 bp, Artificial Sequence
  dgRNA
  Armc10
ggggcaactggggcg

SEQ ID NO: 80568 - DNA, 15 bp, Artificial Sequence
  dgRNA
  Armc10
gcggggcgattgcag

SEQ ID NO: 80569 - DNA, 15 bp, Artificial Sequence
  dgRNA
  Cln6
ctcccgcccgccctg

SEQ ID NO: 80570 - DNA, 15 bp, Artificial Sequence
  dgRNA
  Cln6
gcaagaccggagagg

SEQ ID NO: 80571 - DNA, 15 bp, Artificial Sequence
  dgRNA
  Cln6
ggggcaagaccggag

SEQ ID NO: 80572 - DNA, 15 bp, Artificial Sequence
  dgRNA
  Cln6
cgcggggccccaggg

SEQ ID NO: 80573 - DNA, 15 bp, Artificial Sequence
  dgRNA
  Dnah11
tagataaatttacca

SEQ ID NO: 80574 - DNA, 15 bp, Artificial Sequence
  dgRNA
  Dnah11
ggcggcaaatttagc

SEQ ID NO: 80575 - DNA, 15 bp, Artificial Sequence
  dgRNA
  Dnah11
gccgctaactagtcc

SEQ ID NO: 80576 - DNA, 15 bp, Artificial Sequence
  dgRNA
  Dnah11
aatccctagaaagct

SEQ ID NO: 80577 - DNA, 15 bp, Artificial Sequence
  dgRNA
  Enpp4
ctcgggcatccaatc

SEQ ID NO: 80578 - DNA, 15 bp, Artificial Sequence
  dgRNA
  Enpp4
tcgggcatccaatcc

SEQ ID NO: 80579 - DNA, 15 bp, Artificial Sequence
  dgRNA
  Enpp4
tacgcgtctcacact

SEQ ID NO: 80580 - DNA, 15 bp, Artificial Sequence
  dgRNA
  Enpp4
gcgtctcacactcgg

SEQ ID NO: 80581 - DNA, 15 bp, Artificial Sequence
  dgRNA
  Gm1673
cgaggactgagcgcg

SEQ ID NO: 80582 - DNA, 15 bp, Artificial Sequence
  dgRNA
  Gm1673
gcggccagagtgaca

SEQ ID NO: 80583 - DNA, 15 bp, Artificial Sequence
  dgRNA
  Gm1673
tgacaaggtcgcagt

SEQ ID NO: 80584 - DNA, 15 bp, Artificial Sequence
  dgRNA
  Gm1673
ccctcaactgatctc

SEQ ID NO: 80585 - DNA, 15 bp, Artificial Sequence
  dgRNA
  L3mbtl3
acaccgggtgctggg

SEQ ID NO: 80586 - DNA, 15 bp, Artificial Sequence
  dgRNA
  L3mbtl3
gctgggtggcggcgc

SEQ ID NO: 80587 - DNA, 15 bp, Artificial Sequence
  dgRNA
  L3mbtl3
ctgggtggcggcgct

SEQ ID NO: 80588 - DNA, 15 bp, Artificial Sequence
  dgRNA
  L3mbtl3
tgggtggcggcgctg

SEQ ID NO: 80589 - DNA, 15 bp, Artificial Sequence
  dgRNA
  Micall2
tattcttcaagtccc

SEQ ID NO: 80590 - DNA, 15 bp, Artificial Sequence
  dgRNA
  Micall2
tgggcgtgccctttg

SEQ ID NO: 80591 - DNA, 15 bp, Artificial Sequence
  dgRNA
  Micall2
gggcgtgccctttgt

SEQ ID NO: 80592 - DNA, 15 bp, Artificial Sequence
  dgRNA
  Micall2
ggcgtgccctttgtg

SEQ ID NO: 80593 - DNA, 15 bp, Artificial Sequence
  dgRNA
  Apobr
cgagtctgagtcacc

SEQ ID NO: 80594 - DNA, 15 bp, Artificial Sequence
  dgRNA
  Apobr
gggtggagatttgtc

SEQ ID NO: 80595 - DNA, 15 bp, Artificial Sequence
  dgRNA
  Apobr
ggtggagatttgtca

SEQ ID NO: 80596 - DNA, 15 bp, Artificial Sequence
  dgRNA
  Apobr
gatcgggccagaaag

SEQ ID NO: 80597 - DNA, 15 bp, Artificial Sequence
  dgRNA
  Ccdc170
acttcccagttcata

SEQ ID NO: 80598 - DNA, 15 bp, Artificial Sequence
  dgRNA
  Ccdc170
tctcttactaggtcg

SEQ ID NO: 80599 - DNA, 15 bp, Artificial Sequence
  dgRNA
  Ccdc170
gctctcttactaggt

SEQ ID NO: 80600 - DNA, 15 bp, Artificial Sequence
  dgRNA
  Ccdc170
gattgctctcttact

SEQ ID NO: 80601 - DNA, 15 bp, Artificial Sequence
  dgRNA
  Lrrc34
atgtgtaacctagag

SEQ ID NO: 80602 - DNA, 15 bp, Artificial Sequence
  dgRNA
  Lrrc34
taacctagagcggat

SEQ ID NO: 80603 - DNA, 15 bp, Artificial Sequence
  dgRNA
  Lrrc34
ccacttcaggcctcg

SEQ ID NO: 80604 - DNA, 15 bp, Artificial Sequence
  dgRNA
  Lrrc34
accccgccctcttaa

SEQ ID NO: 80605 - DNA, 15 bp, Artificial Sequence
  dgRNA
  Rfx1
cttcgcttgcctttt

SEQ ID NO: 80606 - DNA, 15 bp, Artificial Sequence
  dgRNA
  Rfx1
ttcgcttgcctttta

SEQ ID NO: 80607 - DNA, 15 bp, Artificial Sequence
  dgRNA
  Rfx1
cggacgtccgaactg

SEQ ID NO: 80608 - DNA, 15 bp, Artificial Sequence
  dgRNA
  Rfx1
tccgaactgaggaat

SEQ ID NO: 80609 - DNA, 15 bp, Artificial Sequence
  dgRNA
  Lrif1
gtagcagcttacctc

SEQ ID NO: 80610 - DNA, 15 bp, Artificial Sequence
  dgRNA
  Lrif1
ttatgcgtgtttccc

SEQ ID NO: 80611 - DNA, 15 bp, Artificial Sequence
  dgRNA
  Lrif1
tcagccgctctctcg

SEQ ID NO: 80612 - DNA, 15 bp, Artificial Sequence
  dgRNA
  Lrif1
cagccgctctctcgc

SEQ ID NO: 80613 - DNA, 15 bp, Artificial Sequence
  dgRNA
  Kin
ctcagtgcgcgtgcg

SEQ ID NO: 80614 - DNA, 15 bp, Artificial Sequence
  dgRNA
  Kin
tcagtgcgcgtgcgc

SEQ ID NO: 80615 - DNA, 15 bp, Artificial Sequence
  dgRNA
  Kin
cgtgcgcgggagctc

SEQ ID NO: 80616 - DNA, 15 bp, Artificial Sequence
  dgRNA
  Kin
ctccgcctgcgtcct

SEQ ID NO: 80617 - DNA, 15 bp, Artificial Sequence
  dgRNA
  Ndufaf7
cctgtttgggacgcc

SEQ ID NO: 80618 - DNA, 15 bp, Artificial Sequence
  dgRNA
  Ndufaf7
ctgtttgggacgcca

SEQ ID NO: 80619 - DNA, 15 bp, Artificial Sequence
  dgRNA
  Ndufaf7
gacgccagggctgct

SEQ ID NO: 80620 - DNA, 15 bp, Artificial Sequence
  dgRNA
  Ndufaf7
ggcaaggaacgccac

SEQ ID NO: 80621 - DNA, 15 bp, Artificial Sequence
  dgRNA
  Zfp532
tgccatgcttcaatc

SEQ ID NO: 80622 - DNA, 15 bp, Artificial Sequence
  dgRNA
  Zfp532
tcaatctggccccag

SEQ ID NO: 80623 - DNA, 15 bp, Artificial Sequence
  dgRNA
  Zfp532
ctttacgttctataa

SEQ ID NO: 80624 - DNA, 15 bp, Artificial Sequence
  dgRNA
  Zfp532
tctttacgttctata

SEQ ID NO: 80625 - DNA, 15 bp, Artificial Sequence
  dgRNA
  Capzb
gccagacgtactgcc

SEQ ID NO: 80626 - DNA, 15 bp, Artificial Sequence
  dgRNA
  Capzb
ccagacgtactgcca

SEQ ID NO: 80627 - DNA, 15 bp, Artificial Sequence
  dgRNA
  Capzb
gtactgccagggctt

SEQ ID NO: 80628 - DNA, 15 bp, Artificial Sequence
  dgRNA
  Capzb
tactgccagggctta

SEQ ID NO: 80629 - DNA, 15 bp, Artificial Sequence
  dgRNA
  Zfp871
atcaagccttacgtt

SEQ ID NO: 80630 - DNA, 15 bp, Artificial Sequence
  dgRNA
  Zfp871
ttacgttcggattag

SEQ ID NO: 80631 - DNA, 15 bp, Artificial Sequence
  dgRNA
  Zfp871
ttcggattagaggtt

SEQ ID NO: 80632 - DNA, 15 bp, Artificial Sequence
  dgRNA
  Zfp871
cacagtacactcgag

SEQ ID NO: 80633 - DNA, 15 bp, Artificial Sequence
  dgRNA
  Ctnnal1
cagactatgggtcag

SEQ ID NO: 80634 - DNA, 15 bp, Artificial Sequence
  dgRNA
  Ctnnal1
agactatgggtcagt

SEQ ID NO: 80635 - DNA, 15 bp, Artificial Sequence
  dgRNA
  Ctnnal1
gtgggcgggacgtag

SEQ ID NO: 80636 - DNA, 15 bp, Artificial Sequence
  dgRNA
  Ctnnal1
tgggcgggacgtaga

SEQ ID NO: 80637 - DNA, 15 bp, Artificial Sequence
  dgRNA
  Cdx4
ctgaagtggcgctga

SEQ ID NO: 80638 - DNA, 15 bp, Artificial Sequence
  dgRNA
  Cdx4
tgaagtggcgctgat

SEQ ID NO: 80639 - DNA, 15 bp, Artificial Sequence
  dgRNA
  Cdx4
tggcgctgatgggct

SEQ ID NO: 80640 - DNA, 15 bp, Artificial Sequence
  dgRNA
  Cdx4
gggctaggagctagg

SEQ ID NO: 80641 - DNA, 15 bp, Artificial Sequence
  dgRNA
  Rhpn2
ggggcctaggcgaga

SEQ ID NO: 80642 - DNA, 15 bp, Artificial Sequence
  dgRNA
  Rhpn2
gggcctaggcgagat

SEQ ID NO: 80643 - DNA, 15 bp, Artificial Sequence
  dgRNA
  Rhpn2
ggcctaggcgagatg

SEQ ID NO: 80644 - DNA, 15 bp, Artificial Sequence
  dgRNA
  Rhpn2
ggaggactgcaaatg

SEQ ID NO: 80645 - DNA, 15 bp, Artificial Sequence
  dgRNA
  Dhx37
gtctcagatcatatc

SEQ ID NO: 80646 - DNA, 15 bp, Artificial Sequence
  dgRNA
  Dhx37
aggcacgtctaggcc

SEQ ID NO: 80647 - DNA, 15 bp, Artificial Sequence
  dgRNA
  Dhx37
ccccttatttacata

SEQ ID NO: 80648 - DNA, 15 bp, Artificial Sequence
  dgRNA
  Dhx37
acagacagagtacgc

SEQ ID NO: 80649 - DNA, 15 bp, Artificial Sequence
  dgRNA
  Aqr
ctagttctgcttccg

SEQ ID NO: 80650 - DNA, 15 bp, Artificial Sequence
  dgRNA
  Aqr
gcttccggggaacgc

SEQ ID NO: 80651 - DNA, 15 bp, Artificial Sequence
  dgRNA
  Aqr
cttccggggaacgcc

SEQ ID NO: 80652 - DNA, 15 bp, Artificial Sequence
  dgRNA
  Aqr
acgccgggacttctc

SEQ ID NO: 80653 - DNA, 15 bp, Artificial Sequence
  dgRNA
  Ctf1
tctaagctcacaagc

SEQ ID NO: 80654 - DNA, 15 bp, Artificial Sequence
  dgRNA
  Ctf1
ccggttactgagctc

SEQ ID NO: 80655 - DNA, 15 bp, Artificial Sequence
  dgRNA
  Ctf1
cggttactgagctct

SEQ ID NO: 80656 - DNA, 15 bp, Artificial Sequence
  dgRNA
  Ctf1
ggtctgaactatgat

SEQ ID NO: 80657 - DNA, 15 bp, Artificial Sequence
  dgRNA
  Zfp169
cggaagtacaccgac

SEQ ID NO: 80658 - DNA, 15 bp, Artificial Sequence
  dgRNA
  Zfp169
gacgactgcaggatg

SEQ ID NO: 80659 - DNA, 15 bp, Artificial Sequence
  dgRNA
  Zfp169
acaggtgacgactgc

SEQ ID NO: 80660 - DNA, 15 bp, Artificial Sequence
  dgRNA
  Zfp169
atcgtccacaggcac

SEQ ID NO: 80661 - DNA, 15 bp, Artificial Sequence
  dgRNA
  Ucn
ggatacgcacccctc

SEQ ID NO: 80662 - DNA, 15 bp, Artificial Sequence
  dgRNA
  Ucn
gatacgcacccctct

SEQ ID NO: 80663 - DNA, 15 bp, Artificial Sequence
  dgRNA
  Ucn
atacgcacccctctg

SEQ ID NO: 80664 - DNA, 15 bp, Artificial Sequence
  dgRNA
  Ucn
tacgcacccctctgg

SEQ ID NO: 80665 - DNA, 15 bp, Artificial Sequence
  dgRNA
  Adrb2
cctccggggagccgc

SEQ ID NO: 80666 - DNA, 15 bp, Artificial Sequence
  dgRNA
  Adrb2
ctccggggagccgct

SEQ ID NO: 80667 - DNA, 15 bp, Artificial Sequence
  dgRNA
  Adrb2
ccgctgggccccgcc

SEQ ID NO: 80668 - DNA, 15 bp, Artificial Sequence
  dgRNA
  Adrb2
cgctgggccccgccc

SEQ ID NO: 80669 - DNA, 15 bp, Artificial Sequence
  dgRNA
  Ctsl
gtggaccctccaaag

SEQ ID NO: 80670 - DNA, 15 bp, Artificial Sequence
  dgRNA
  Ctsl
atcagcctcgcccca

SEQ ID NO: 80671 - DNA, 15 bp, Artificial Sequence
  dgRNA
  Ctsl
caaggcttgcaccac

SEQ ID NO: 80672 - DNA, 15 bp, Artificial Sequence
  dgRNA
  Ctsl
cttgcaccacaggac

SEQ ID NO: 80673 - DNA, 15 bp, Artificial Sequence
  dgRNA
  Ldhd
caaagtccgagtgcc

SEQ ID NO: 80674 - DNA, 15 bp, Artificial Sequence
  dgRNA
  Ldhd
agtccgagtgcccgg

SEQ ID NO: 80675 - DNA, 15 bp, Artificial Sequence
  dgRNA
  Ldhd
gtccgagtgcccggt

SEQ ID NO: 80676 - DNA, 15 bp, Artificial Sequence
  dgRNA
  Ldhd
tacacgatgtttgtt

SEQ ID NO: 80677 - DNA, 15 bp, Artificial Sequence
  dgRNA
  Kmt2a
catatgcagattgca

SEQ ID NO: 80678 - DNA, 15 bp, Artificial Sequence
  dgRNA
  Kmt2a
tgcagattgcagggc

SEQ ID NO: 80679 - DNA, 15 bp, Artificial Sequence
  dgRNA
  Kmt2a
caggcgggcgccacc

SEQ ID NO: 80680 - DNA, 15 bp, Artificial Sequence
  dgRNA
  Kmt2a
gcgccacccggcgct

SEQ ID NO: 80681 - DNA, 15 bp, Artificial Sequence
  dgRNA
  Fam136a
cgccagggggcgatg

SEQ ID NO: 80682 - DNA, 15 bp, Artificial Sequence
  dgRNA
  Fam136a
gggcgatgaggatgc

SEQ ID NO: 80683 - DNA, 15 bp, Artificial Sequence
  dgRNA
  Fam136a
tgaggatgcgggaac

SEQ ID NO: 80684 - DNA, 15 bp, Artificial Sequence
  dgRNA
  Fam136a
cgggaacgcttactg

SEQ ID NO: 80685 - DNA, 15 bp, Artificial Sequence
  dgRNA
  Pon3
gagccctccatgtgg

SEQ ID NO: 80686 - DNA, 15 bp, Artificial Sequence
  dgRNA
  Pon3
tttgagccttggcgc

SEQ ID NO: 80687 - DNA, 15 bp, Artificial Sequence
  dgRNA
  Pon3
ccaagactgctagaa

SEQ ID NO: 80688 - DNA, 15 bp, Artificial Sequence
  dgRNA
  Pon3
gcaggcggggcacaa

SEQ ID NO: 80689 - DNA, 15 bp, Artificial Sequence
  dgRNA
  2200002J24Rik
attccgctgagcata

SEQ ID NO: 80690 - DNA, 15 bp, Artificial Sequence
  dgRNA
  2200002J24Rik
ttccgctgagcatat

SEQ ID NO: 80691 - DNA, 15 bp, Artificial Sequence
  dgRNA
  2200002J24Rik
gattgacagactacc

SEQ ID NO: 80692 - DNA, 15 bp, Artificial Sequence
  dgRNA
  2200002J24Rik
ccactaggcctgctc

SEQ ID NO: 80693 - DNA, 15 bp, Artificial Sequence
  dgRNA
  Pcdhb3
ctagtttaacttgtg

SEQ ID NO: 80694 - DNA, 15 bp, Artificial Sequence
  dgRNA
  Pcdhb3
gaaactccttcagta

SEQ ID NO: 80695 - DNA, 15 bp, Artificial Sequence
  dgRNA
  Pcdhb3
tcaagagatttgata

SEQ ID NO: 80696 - DNA, 15 bp, Artificial Sequence
  dgRNA
  Pcdhb3
ctgagaacgaacgca

SEQ ID NO: 80697 - DNA, 15 bp, Artificial Sequence
  dgRNA
  Ythdf1
caccgtctccccaat

SEQ ID NO: 80698 - DNA, 15 bp, Artificial Sequence
  dgRNA
  Ythdf1
aataggcgccgcccc

SEQ ID NO: 80699 - DNA, 15 bp, Artificial Sequence
  dgRNA
  Ythdf1
tcgccccgccccatc

SEQ ID NO: 80700 - DNA, 15 bp, Artificial Sequence
  dgRNA
  Ythdf1
ccgccccatccggtc

SEQ ID NO: 80701 - DNA, 15 bp, Artificial Sequence
  dgRNA
  Scyl3
cgtgtttgagaaaac

SEQ ID NO: 80702 - DNA, 15 bp, Artificial Sequence
  dgRNA
  Scyl3
ggctacatgctaccc

SEQ ID NO: 80703 - DNA, 15 bp, Artificial Sequence
  dgRNA
  Scyl3
gcatagatgtgagtc

SEQ ID NO: 80704 - DNA, 15 bp, Artificial Sequence
  dgRNA
  Scyl3
gcatcatcctcccag

SEQ ID NO: 80705 - DNA, 15 bp, Artificial Sequence
  dgRNA
  Nipal1
gacaccggtgactga

SEQ ID NO: 80706 - DNA, 15 bp, Artificial Sequence
  dgRNA
  Nipal1
gcggcgatgagcgag

SEQ ID NO: 80707 - DNA, 15 bp, Artificial Sequence
  dgRNA
  Nipal1
gcgatgagcgagcgg

SEQ ID NO: 80708 - DNA, 15 bp, Artificial Sequence
  dgRNA
  Nipal1
cgatgagcgagcggt

SEQ ID NO: 80709 - DNA, 15 bp, Artificial Sequence
  dgRNA
  Krt79
ggagggcttacgggg

SEQ ID NO: 80710 - DNA, 15 bp, Artificial Sequence
  dgRNA
  Krt79
gagggcttacggggt

SEQ ID NO: 80711 - DNA, 15 bp, Artificial Sequence
  dgRNA
  Krt79
agggcttacggggtg

SEQ ID NO: 80712 - DNA, 15 bp, Artificial Sequence
  dgRNA
  Krt79
aagtagtctctgctc

SEQ ID NO: 80713 - DNA, 15 bp, Artificial Sequence
  dgRNA
  Emilin1
tggcctcaagcccgg

SEQ ID NO: 80714 - DNA, 15 bp, Artificial Sequence
  dgRNA
  Emilin1
agatgtggcgcacga

SEQ ID NO: 80715 - DNA, 15 bp, Artificial Sequence
  dgRNA
  Emilin1
gtggcgcacgatggt

SEQ ID NO: 80716 - DNA, 15 bp, Artificial Sequence
  dgRNA
  Emilin1
gcacgatggttggag

SEQ ID NO: 80717 - DNA, 15 bp, Artificial Sequence
  dgRNA
  Tspan10
caatagtgatggcca

SEQ ID NO: 80718 - DNA, 15 bp, Artificial Sequence
  dgRNA
  Tspan10
catgggtccagcatc

SEQ ID NO: 80719 - DNA, 15 bp, Artificial Sequence
  dgRNA
  Tspan10
actgtgcagacatta

SEQ ID NO: 80720 - DNA, 15 bp, Artificial Sequence
  dgRNA
  Tspan10
cattagggatatctc

SEQ ID NO: 80721 - DNA, 15 bp, Artificial Sequence
  dgRNA
  Psen1
ggcctgtgtctccga

SEQ ID NO: 80722 - DNA, 15 bp, Artificial Sequence
  dgRNA
  Psen1
ccgagggccgcgctg

SEQ ID NO: 80723 - DNA, 15 bp, Artificial Sequence
  dgRNA
  Psen1
cgagggccgcgctgc

SEQ ID NO: 80724 - DNA, 15 bp, Artificial Sequence
  dgRNA
  Psen1
gctgcgggcgtctct

SEQ ID NO: 80725 - DNA, 15 bp, Artificial Sequence
  dgRNA
  Entpd3
tggctaccccccacg

SEQ ID NO: 80726 - DNA, 15 bp, Artificial Sequence
  dgRNA
  Entpd3
atcctcatgccggac

SEQ ID NO: 80727 - DNA, 15 bp, Artificial Sequence
  dgRNA
  Entpd3
tcatgccggacaggc

SEQ ID NO: 80728 - DNA, 15 bp, Artificial Sequence
  dgRNA
  Entpd3
catgccggacaggct

SEQ ID NO: 80729 - DNA, 15 bp, Artificial Sequence
  dgRNA
  2610528J11Rik
actaatccgcagctg

SEQ ID NO: 80730 - DNA, 15 bp, Artificial Sequence
  dgRNA
  2610528J11Rik
ctaatccgcagctgt

SEQ ID NO: 80731 - DNA, 15 bp, Artificial Sequence
  dgRNA
  2610528J11Rik
taatccgcagctgtg

SEQ ID NO: 80732 - DNA, 15 bp, Artificial Sequence
  dgRNA
  2610528J11Rik
aatccgcagctgtgg

SEQ ID NO: 80733 - DNA, 15 bp, Artificial Sequence
  dgRNA
  Mc4r
ccactgaatacggat

SEQ ID NO: 80734 - DNA, 15 bp, Artificial Sequence
  dgRNA
  Mc4r
tacggattggtcaga

SEQ ID NO: 80735 - DNA, 15 bp, Artificial Sequence
  dgRNA
  Mc4r
tcagcagcccgcact

SEQ ID NO: 80736 - DNA, 15 bp, Artificial Sequence
  dgRNA
  Mc4r
cagcaaccggctcag

SEQ ID NO: 80737 - DNA, 15 bp, Artificial Sequence
  dgRNA
  Ucp3
aagctaaaccagatc

SEQ ID NO: 80738 - DNA, 15 bp, Artificial Sequence
  dgRNA
  Ucp3
tcagaattaggtttc

SEQ ID NO: 80739 - DNA, 15 bp, Artificial Sequence
  dgRNA
  Ucp3
ggtcagctggtgcac

SEQ ID NO: 80740 - DNA, 15 bp, Artificial Sequence
  dgRNA
  Ucp3
gtcagctggtgcaca

SEQ ID NO: 80741 - DNA, 15 bp, Artificial Sequence
  dgRNA
  Zswim6
ctaggttctccctat

SEQ ID NO: 80742 - DNA, 15 bp, Artificial Sequence
  dgRNA
  Zswim6
atcggcgctcctcct

SEQ ID NO: 80743 - DNA, 15 bp, Artificial Sequence
  dgRNA
  Zswim6
tcggcgatgtcgtca

SEQ ID NO: 80744 - DNA, 15 bp, Artificial Sequence
  dgRNA
  Zswim6
atgtcgtcacggcct

SEQ ID NO: 80745 - DNA, 15 bp, Artificial Sequence
  dgRNA
  Ndel1
gcgcagcacagcttc

SEQ ID NO: 80746 - DNA, 15 bp, Artificial Sequence
  dgRNA
  Ndel1
ttccggagacagcac

SEQ ID NO: 80747 - DNA, 15 bp, Artificial Sequence
  dgRNA
  Ndel1
tccggagacagcaca

SEQ ID NO: 80748 - DNA, 15 bp, Artificial Sequence
  dgRNA
  Ndel1
aacccacctccttcg

SEQ ID NO: 80749 - DNA, 15 bp, Artificial Sequence
  dgRNA
  Foxs1
agagcttccgactgc

SEQ ID NO: 80750 - DNA, 15 bp, Artificial Sequence
  dgRNA
  Foxs1
ccttagacttgacaa

SEQ ID NO: 80751 - DNA, 15 bp, Artificial Sequence
  dgRNA
  Foxs1
tagacttgacaaggg

SEQ ID NO: 80752 - DNA, 15 bp, Artificial Sequence
  dgRNA
  Foxs1
gagggaaggaccgcg

SEQ ID NO: 80753 - DNA, 15 bp, Artificial Sequence
  dgRNA
  Ranbp1
cgctcacgccagcgt

SEQ ID NO: 80754 - DNA, 15 bp, Artificial Sequence
  dgRNA
  Ranbp1
tcacgccagcgtcgg

SEQ ID NO: 80755 - DNA, 15 bp, Artificial Sequence
  dgRNA
  Ranbp1
gcggaagtgcgcgcg

SEQ ID NO: 80756 - DNA, 15 bp, Artificial Sequence
  dgRNA
  Ranbp1
cggaagtgcgcgcgt

SEQ ID NO: 80757 - DNA, 15 bp, Artificial Sequence
  dgRNA
  Pak6
ccccttggtcgagcc

SEQ ID NO: 80758 - DNA, 15 bp, Artificial Sequence
  dgRNA
  Pak6
ccctcgctatctctc

SEQ ID NO: 80759 - DNA, 15 bp, Artificial Sequence
  dgRNA
  Pak6
gagctcccgcgctct

SEQ ID NO: 80760 - DNA, 15 bp, Artificial Sequence
  dgRNA
  Pak6
gtccaactccccgcc

SEQ ID NO: 80761 - DNA, 15 bp, Artificial Sequence
  dgRNA
  Fsd1l
tcctctccgccggtg

SEQ ID NO: 80762 - DNA, 15 bp, Artificial Sequence
  dgRNA
  Fsd1l
cctctccgccggtgc

SEQ ID NO: 80763 - DNA, 15 bp, Artificial Sequence
  dgRNA
  Fsd1l
cgccggtgcgggtgt

SEQ ID NO: 80764 - DNA, 15 bp, Artificial Sequence
  dgRNA
  Fsd1l
gccgccctttcaccc

SEQ ID NO: 80765 - DNA, 15 bp, Artificial Sequence
  dgRNA
  Iyd
tgcatgcgtcagagc

SEQ ID NO: 80766 - DNA, 15 bp, Artificial Sequence
  dgRNA
  Iyd
gacatcaatgaccat

SEQ ID NO: 80767 - DNA, 15 bp, Artificial Sequence
  dgRNA
  Iyd
cagttgggtgcgtgt

SEQ ID NO: 80768 - DNA, 15 bp, Artificial Sequence
  dgRNA
  Iyd
acagttgggtgcgtg

SEQ ID NO: 80769 - DNA, 15 bp, Artificial Sequence
  dgRNA
  Cpsf1
agttcttatcaagct

SEQ ID NO: 80770 - DNA, 15 bp, Artificial Sequence
  dgRNA
  Cpsf1
tcaagctaggccact

SEQ ID NO: 80771 - DNA, 15 bp, Artificial Sequence
  dgRNA
  Cpsf1
caagctaggccacta

SEQ ID NO: 80772 - DNA, 15 bp, Artificial Sequence
  dgRNA
  Cpsf1
cttcgctcgcagcca

SEQ ID NO: 80773 - DNA, 15 bp, Artificial Sequence
  dgRNA
  Mab21l3
gactggtataagacc

SEQ ID NO: 80774 - DNA, 15 bp, Artificial Sequence
  dgRNA
  Mab21l3
actggtataagacct

SEQ ID NO: 80775 - DNA, 15 bp, Artificial Sequence
  dgRNA
  Mab21l3
cgccccagcgcctgg

SEQ ID NO: 80776 - DNA, 15 bp, Artificial Sequence
  dgRNA
  Mab21l3
gcaaatttggggccg

SEQ ID NO: 80777 - DNA, 15 bp, Artificial Sequence
  dgRNA
  Zufsp
cggttttagcatatc

SEQ ID NO: 80778 - DNA, 15 bp, Artificial Sequence
  dgRNA
  Zufsp
ttagcatatctggag

SEQ ID NO: 80779 - DNA, 15 bp, Artificial Sequence
  dgRNA
  Zufsp
gcaccgcaactcaga

SEQ ID NO: 80780 - DNA, 15 bp, Artificial Sequence
  dgRNA
  Zufsp
cagacggatctgcag

SEQ ID NO: 80781 - DNA, 15 bp, Artificial Sequence
  dgRNA
  Iqgap1
gcgcctaaaaacatt

SEQ ID NO: 80782 - DNA, 15 bp, Artificial Sequence
  dgRNA
  Iqgap1
agctgtagacattgg

SEQ ID NO: 80783 - DNA, 15 bp, Artificial Sequence
  dgRNA
  Iqgap1
gtcagagccgcagat

SEQ ID NO: 80784 - DNA, 15 bp, Artificial Sequence
  dgRNA
  Iqgap1
tcagagccgcagata

SEQ ID NO: 80785 - DNA, 15 bp, Artificial Sequence
  dgRNA
  Ganc
gcagcatagtttgac

SEQ ID NO: 80786 - DNA, 15 bp, Artificial Sequence
  dgRNA
  Ganc
tcgaaactaaaagtg

SEQ ID NO: 80787 - DNA, 15 bp, Artificial Sequence
  dgRNA
  Ganc
gatcaggtcagcttt

SEQ ID NO: 80788 - DNA, 15 bp, Artificial Sequence
  dgRNA
  Ganc
aagactgacccttat

SEQ ID NO: 80789 - DNA, 15 bp, Artificial Sequence
  dgRNA
  Mmp25
gttggaacaatggtt

SEQ ID NO: 80790 - DNA, 15 bp, Artificial Sequence
  dgRNA
  Mmp25
ttggaacaatggttc

SEQ ID NO: 80791 - DNA, 15 bp, Artificial Sequence
  dgRNA
  Mmp25
tggaacaatggttcg

SEQ ID NO: 80792 - DNA, 15 bp, Artificial Sequence
  dgRNA
  Mmp25
catactgcgcacagc

SEQ ID NO: 80793 - DNA, 15 bp, Artificial Sequence
  dgRNA
  9830147E19Rik
acagcaacgtgggcc

SEQ ID NO: 80794 - DNA, 15 bp, Artificial Sequence
  dgRNA
  9830147E19Rik
ccggtgctatgctgc

SEQ ID NO: 80795 - DNA, 15 bp, Artificial Sequence
  dgRNA
  9830147E19Rik
tccaaactatatctg

SEQ ID NO: 80796 - DNA, 15 bp, Artificial Sequence
  dgRNA
  9830147E19Rik
cacgttgctgttcca

SEQ ID NO: 80797 - DNA, 15 bp, Artificial Sequence
  dgRNA
  Ash2l
cgcgggggctggcga

SEQ ID NO: 80798 - DNA, 15 bp, Artificial Sequence
  dgRNA
  Ash2l
ggccgtcagccgccc

SEQ ID NO: 80799 - DNA, 15 bp, Artificial Sequence
  dgRNA
  Ash2l
gccgtcagccgcccc

SEQ ID NO: 80800 - DNA, 15 bp, Artificial Sequence
  dgRNA
  Ash2l
cagccgccccgggag

SEQ ID NO: 80801 - DNA, 15 bp, Artificial Sequence
  dgRNA
  Otud1
ccggccacgcccatg

SEQ ID NO: 80802 - DNA, 15 bp, Artificial Sequence
  dgRNA
  Otud1
ccatgaggtctccgc

SEQ ID NO: 80803 - DNA, 15 bp, Artificial Sequence
  dgRNA
  Otud1
gaggtctccgctgga

SEQ ID NO: 80804 - DNA, 15 bp, Artificial Sequence
  dgRNA
  Otud1
gtctccgctggaggg

SEQ ID NO: 80805 - DNA, 15 bp, Artificial Sequence
  dgRNA
  Lrrc4c
cttttacgaggaagc

SEQ ID NO: 80806 - DNA, 15 bp, Artificial Sequence
  dgRNA
  Lrrc4c
acaatctcttttacg

SEQ ID NO: 80807 - DNA, 15 bp, Artificial Sequence
  dgRNA
  Mcts1
gaagtcccgcccttt

SEQ ID NO: 80808 - DNA, 15 bp, Artificial Sequence
  dgRNA
  Mcts1
ttcggctacccccaa

SEQ ID NO: 80809 - DNA, 15 bp, Artificial Sequence
  dgRNA
  Mcts1
acaaaagcgtcaacg

SEQ ID NO: 80810 - DNA, 15 bp, Artificial Sequence
  dgRNA
  Mcts1
caacgtggagtcgag

SEQ ID NO: 80811 - DNA, 15 bp, Artificial Sequence
  dgRNA
  Fxyd3
ggcgtccctcgcctc

SEQ ID NO: 80812 - DNA, 15 bp, Artificial Sequence
  dgRNA
  Fxyd3
gcgtccctcgcctca

SEQ ID NO: 80813 - DNA, 15 bp, Artificial Sequence
  dgRNA
  Fxyd3
aactatagtagcctc

SEQ ID NO: 80814 - DNA, 15 bp, Artificial Sequence
  dgRNA
  Fxyd3
cgccctgagcaaacc

SEQ ID NO: 80815 - DNA, 15 bp, Artificial Sequence
  dgRNA
  Papola
ctacagcctctcgct

SEQ ID NO: 80816 - DNA, 15 bp, Artificial Sequence
  dgRNA
  Papola
aaagcgtgagatcac

SEQ ID NO: 80817 - DNA, 15 bp, Artificial Sequence
  dgRNA
  Papola
aagcgtgagatcacc

SEQ ID NO: 80818 - DNA, 15 bp, Artificial Sequence
  dgRNA
  Papola
agcgtgagatcaccg

SEQ ID NO: 80819 - DNA, 15 bp, Artificial Sequence
  dgRNA
  Herc2
acgctgctcgtccat

SEQ ID NO: 80820 - DNA, 15 bp, Artificial Sequence
  dgRNA
  Herc2
tcacccttgcgctat

SEQ ID NO: 80821 - DNA, 15 bp, Artificial Sequence
  dgRNA
  Herc2
cacccttgcgctatt

SEQ ID NO: 80822 - DNA, 15 bp, Artificial Sequence
  dgRNA
  Herc2
ccttgcgctattggg

SEQ ID NO: 80823 - DNA, 15 bp, Artificial Sequence
  dgRNA
  Rps17
aagcacggaactatt

SEQ ID NO: 80824 - DNA, 15 bp, Artificial Sequence
  dgRNA
  Rps17
cggaactatttggag

SEQ ID NO: 80825 - DNA, 15 bp, Artificial Sequence
  dgRNA
  Rps17
agacggccgagctgc

SEQ ID NO: 80826 - DNA, 15 bp, Artificial Sequence
  dgRNA
  Rps17
tcactccactccgct

SEQ ID NO: 80827 - DNA, 15 bp, Artificial Sequence
  dgRNA
  Ebpl
aaaatccccaccgtt

SEQ ID NO: 80828 - DNA, 15 bp, Artificial Sequence
  dgRNA
  Ebpl
tgtaaagcatgaacc

SEQ ID NO: 80829 - DNA, 15 bp, Artificial Sequence
  dgRNA
  Ebpl
gtaaagcatgaacct

SEQ ID NO: 80830 - DNA, 15 bp, Artificial Sequence
  dgRNA
  Ebpl
ggtccaggaaccatc

SEQ ID NO: 80831 - DNA, 15 bp, Artificial Sequence
  dgRNA
  Olfr142
taagtaagaatgtac

SEQ ID NO: 80832 - DNA, 15 bp, Artificial Sequence
  dgRNA
  Olfr142
tggacatcagatgat

SEQ ID NO: 80833 - DNA, 15 bp, Artificial Sequence
  dgRNA
  Olfr142
tcagttcacgtgtgt

SEQ ID NO: 80834 - DNA, 15 bp, Artificial Sequence
  dgRNA
  Zfp952
cagcggtactcagaa

SEQ ID NO: 80835 - DNA, 15 bp, Artificial Sequence
  dgRNA
  Zfp952
tttaattaagctcgt

SEQ ID NO: 80836 - DNA, 15 bp, Artificial Sequence
  dgRNA
  Zfp952
aattaagctcgtagg

SEQ ID NO: 80837 - DNA, 15 bp, Artificial Sequence
  dgRNA
  Zfp952
aagctcgtaggaggc

SEQ ID NO: 80838 - DNA, 15 bp, Artificial Sequence
  dgRNA
  Ank1
cggggtggggatcgc

SEQ ID NO: 80839 - DNA, 15 bp, Artificial Sequence
  dgRNA
  Dhx16
cgcgcacagatcatt

SEQ ID NO: 80840 - DNA, 15 bp, Artificial Sequence
  dgRNA
  Dhx16
gcgcacagatcatta

SEQ ID NO: 80841 - DNA, 15 bp, Artificial Sequence
  dgRNA
  Dhx16
cgcacagatcattag

SEQ ID NO: 80842 - DNA, 15 bp, Artificial Sequence
  dgRNA
  Dhx16
gcacagatcattagg

SEQ ID NO: 80843 - DNA, 15 bp, Artificial Sequence
  dgRNA
  Nr1h4
tgctaggtgagctgt

SEQ ID NO: 80844 - DNA, 15 bp, Artificial Sequence
  dgRNA
  Nr1h4
gtctctggattgcgc

SEQ ID NO: 80845 - DNA, 15 bp, Artificial Sequence
  dgRNA
  Nr1h4
gcgctggcaattcca

SEQ ID NO: 80846 - DNA, 15 bp, Artificial Sequence
  dgRNA
  Nr1h4
tttacatcatttagc

SEQ ID NO: 80847 - DNA, 15 bp, Artificial Sequence
  dgRNA
  Iqsec2
ggtggcgactgcagg

SEQ ID NO: 80848 - DNA, 15 bp, Artificial Sequence
  dgRNA
  Iqsec2
gtggcgactgcaggt

SEQ ID NO: 80849 - DNA, 15 bp, Artificial Sequence
  dgRNA
  Iqsec2
tgcaggtggggcgcg

SEQ ID NO: 80850 - DNA, 15 bp, Artificial Sequence
  dgRNA
  Iqsec2
gcaggtggggcgcgc

SEQ ID NO: 80851 - DNA, 15 bp, Artificial Sequence
  dgRNA
  Tceal3
tcatcttagtccccc

SEQ ID NO: 80852 - DNA, 15 bp, Artificial Sequence
  dgRNA
  Tceal3
catcttagtccccca

SEQ ID NO: 80853 - DNA, 15 bp, Artificial Sequence
  dgRNA
  Tceal3
atgggtcaggcaagt

SEQ ID NO: 80854 - DNA, 15 bp, Artificial Sequence
  dgRNA
  Tceal3
atatctgcaggctac

SEQ ID NO: 80855 - DNA, 15 bp, Artificial Sequence
  dgRNA
  Nab2
ccgagctgtggaagg

SEQ ID NO: 80856 - DNA, 15 bp, Artificial Sequence
  dgRNA
  Nab2
gccgagctgtggaag

SEQ ID NO: 80857 - DNA, 15 bp, Artificial Sequence
  dgRNA
  Nab2
ggccgagctgtggaa

SEQ ID NO: 80858 - DNA, 15 bp, Artificial Sequence
  dgRNA
  Nab2
accgaggccgagctg

SEQ ID NO: 80859 - DNA, 15 bp, Artificial Sequence
  dgRNA
  Spatc1
ccgtgaaattataat

SEQ ID NO: 80860 - DNA, 15 bp, Artificial Sequence
  dgRNA
  Spatc1
ttgtcaagacattgc

SEQ ID NO: 80861 - DNA, 15 bp, Artificial Sequence
  dgRNA
  Spatc1
ggtaaggcaacacat

SEQ ID NO: 80862 - DNA, 15 bp, Artificial Sequence
  dgRNA
  Spatc1
agagcctactagacc

SEQ ID NO: 80863 - DNA, 15 bp, Artificial Sequence
  dgRNA
  Zfp62
tccgggcagaccagc

SEQ ID NO: 80864 - DNA, 15 bp, Artificial Sequence
  dgRNA
  Zfp62
ccgggcagaccagcc

SEQ ID NO: 80865 - DNA, 15 bp, Artificial Sequence
  dgRNA
  Zfp62
agaccagccgggatt

SEQ ID NO: 80866 - DNA, 15 bp, Artificial Sequence
  dgRNA
  Zfp62
tcggaagtgcccctg

SEQ ID NO: 80867 - DNA, 15 bp, Artificial Sequence
  dgRNA
  Akt1s1
atttctgagtcaccg

SEQ ID NO: 80868 - DNA, 15 bp, Artificial Sequence
  dgRNA
  Akt1s1
ccaccatcttgaaac

SEQ ID NO: 80869 - DNA, 15 bp, Artificial Sequence
  dgRNA
  Akt1s1
taaagggaacgagcg

SEQ ID NO: 80870 - DNA, 15 bp, Artificial Sequence
  dgRNA
  Akt1s1
aaagggaacgagcga

SEQ ID NO: 80871 - DNA, 15 bp, Artificial Sequence
  dgRNA
  Nf1
ccccgagccgtggaa

SEQ ID NO: 80872 - DNA, 15 bp, Artificial Sequence
  dgRNA
  Nf1
aaaggatcccacttc

SEQ ID NO: 80873 - DNA, 15 bp, Artificial Sequence
  dgRNA
  Nf1
ggatcccacttccgg

SEQ ID NO: 80874 - DNA, 15 bp, Artificial Sequence
  dgRNA
  Nf1
gatcccacttccggt

SEQ ID NO: 80875 - DNA, 15 bp, Artificial Sequence
  dgRNA
  Scube2
gactccgcgagcgag

SEQ ID NO: 80876 - DNA, 15 bp, Artificial Sequence
  dgRNA
  Scube2
actccgcgagcgagc

SEQ ID NO: 80877 - DNA, 15 bp, Artificial Sequence
  dgRNA
  Scube2
gggagagcgagcgca

SEQ ID NO: 80878 - DNA, 15 bp, Artificial Sequence
  dgRNA
  Scube2
ctgctgacagcggct

SEQ ID NO: 80879 - DNA, 15 bp, Artificial Sequence
  dgRNA
  Pus3
ctatatttctcgtat

SEQ ID NO: 80880 - DNA, 15 bp, Artificial Sequence
  dgRNA
  Pus3
tctcgtattggcttg

SEQ ID NO: 80881 - DNA, 15 bp, Artificial Sequence
  dgRNA
  Pus3
tggcttgcggtaaag

SEQ ID NO: 80882 - DNA, 15 bp, Artificial Sequence
  dgRNA
  Pus3
agaaacctgcgcatg

SEQ ID NO: 80883 - DNA, 15 bp, Artificial Sequence
  dgRNA
  Kcnq5
aaatccggacctccc

SEQ ID NO: 80884 - DNA, 15 bp, Artificial Sequence
  dgRNA
  Kcnq5
aatccggacctcccc

SEQ ID NO: 80885 - DNA, 15 bp, Artificial Sequence
  dgRNA
  Kcnq5
cggagccccgactct

SEQ ID NO: 80886 - DNA, 15 bp, Artificial Sequence
  dgRNA
  Kcnq5
gctagtccgcccccc

SEQ ID NO: 80887 - DNA, 15 bp, Artificial Sequence
  dgRNA
  Tnk2
cccgtgccggggtgc

SEQ ID NO: 80888 - DNA, 15 bp, Artificial Sequence
  dgRNA
  Tnk2
cggggtgcaggagcg

SEQ ID NO: 80889 - DNA, 15 bp, Artificial Sequence
  dgRNA
  Tnk2
gggtgcaggagcgcg

SEQ ID NO: 80890 - DNA, 15 bp, Artificial Sequence
  dgRNA
  Tnk2
gagggcagcccacgc

SEQ ID NO: 80891 - DNA, 15 bp, Artificial Sequence
  dgRNA
  Arhgef39
tgtcactttagcgtc

SEQ ID NO: 80892 - DNA, 15 bp, Artificial Sequence
  dgRNA
  Arhgef39
cgatgctactacacc

SEQ ID NO: 80893 - DNA, 15 bp, Artificial Sequence
  dgRNA
  Arhgef39
acgacctcgcctagc

SEQ ID NO: 80894 - DNA, 15 bp, Artificial Sequence
  dgRNA
  Arhgef39
acctcgcctagctgg

SEQ ID NO: 80895 - DNA, 15 bp, Artificial Sequence
  dgRNA
  Cntn1
aaggttttcaatccg

SEQ ID NO: 80896 - DNA, 15 bp, Artificial Sequence
  dgRNA
  Cntn1
aatccgcggactaca

SEQ ID NO: 80897 - DNA, 15 bp, Artificial Sequence
  dgRNA
  Cntn1
acaaggactcttcgc

SEQ ID NO: 80898 - DNA, 15 bp, Artificial Sequence
  dgRNA
  Cntn1
aggactcttcgctgg

SEQ ID NO: 80899 - DNA, 15 bp, Artificial Sequence
  dgRNA
  Nhlrc3
gtccttttcggagcg

SEQ ID NO: 80900 - DNA, 15 bp, Artificial Sequence
  dgRNA
  Nhlrc3
gagcgaagagtaagt

SEQ ID NO: 80901 - DNA, 15 bp, Artificial Sequence
  dgRNA
  Nhlrc3
ttcaggcttctgccg

SEQ ID NO: 80902 - DNA, 15 bp, Artificial Sequence
  dgRNA
  Nhlrc3
taccacgctccgaaa

SEQ ID NO: 80903 - DNA, 15 bp, Artificial Sequence
  dgRNA
  Tanc2
cgcgcgctgctccgg

SEQ ID NO: 80904 - DNA, 15 bp, Artificial Sequence
  dgRNA
  Tanc2
gcgcgctgctccggc

SEQ ID NO: 80905 - DNA, 15 bp, Artificial Sequence
  dgRNA
  Tanc2
cgcgctgctccggcg

SEQ ID NO: 80906 - DNA, 15 bp, Artificial Sequence
  dgRNA
  Tanc2
tccggcggggcccgc

SEQ ID NO: 80907 - DNA, 15 bp, Artificial Sequence
  dgRNA
  Mrpl20
ccaccgagtgttcct

SEQ ID NO: 80908 - DNA, 15 bp, Artificial Sequence
  dgRNA
  Mrpl20
ccgagtgttccttgg

SEQ ID NO: 80909 - DNA, 15 bp, Artificial Sequence
  dgRNA
  Mrpl20
gatctgatttccgtc

SEQ ID NO: 80910 - DNA, 15 bp, Artificial Sequence
  dgRNA
  Mrpl20
atctgatttccgtcc

SEQ ID NO: 80911 - DNA, 15 bp, Artificial Sequence
  dgRNA
  Upf1
cctttaggcggttga

SEQ ID NO: 80912 - DNA, 15 bp, Artificial Sequence
  dgRNA
  Upf1
cccgcctcttcgcgc

SEQ ID NO: 80913 - DNA, 15 bp, Artificial Sequence
  dgRNA
  Upf1
cttcgcgcaggcgca

SEQ ID NO: 80914 - DNA, 15 bp, Artificial Sequence
  dgRNA
  Upf1
cccagtgctccggtg

SEQ ID NO: 80915 - DNA, 15 bp, Artificial Sequence
  dgRNA
  Gdnf
ggaggccggtgtgcg

SEQ ID NO: 80916 - DNA, 15 bp, Artificial Sequence
  dgRNA
  Gdnf
cggtgtgcgaggtgt

SEQ ID NO: 80917 - DNA, 15 bp, Artificial Sequence
  dgRNA
  Gdnf
ccttcgccctcctcg

SEQ ID NO: 80918 - DNA, 15 bp, Artificial Sequence
  dgRNA
  Gdnf
tcgccctcctcgcgg

SEQ ID NO: 80919 - DNA, 15 bp, Artificial Sequence
  dgRNA
  Qser1
ccggttcccccgccc

SEQ ID NO: 80920 - DNA, 15 bp, Artificial Sequence
  dgRNA
  Qser1
cggccgcgccatgtg

SEQ ID NO: 80921 - DNA, 15 bp, Artificial Sequence
  dgRNA
  Qser1
ggccgcgccatgtga

SEQ ID NO: 80922 - DNA, 15 bp, Artificial Sequence
  dgRNA
  Qser1
gccgcgccatgtgag

SEQ ID NO: 80923 - DNA, 15 bp, Artificial Sequence
  dgRNA
  Nr2c2
tcgcttgcaacatct

SEQ ID NO: 80924 - DNA, 15 bp, Artificial Sequence
  dgRNA
  Nr2c2
tgcaacatctcggcg

SEQ ID NO: 80925 - DNA, 15 bp, Artificial Sequence
  dgRNA
  Nr2c2
tctcggcgcggcgcc

SEQ ID NO: 80926 - DNA, 15 bp, Artificial Sequence
  dgRNA
  Nr2c2
gcgcggcgccaggca

SEQ ID NO: 80927 - DNA, 15 bp, Artificial Sequence
  dgRNA
  Prss40
tgctcagctcccgcg

SEQ ID NO: 80928 - DNA, 15 bp, Artificial Sequence
  dgRNA
  Prss40
gctcagctcccgcga

SEQ ID NO: 80929 - DNA, 15 bp, Artificial Sequence
  dgRNA
  Prss40
cagctcccgcgaggg

SEQ ID NO: 80930 - DNA, 15 bp, Artificial Sequence
  dgRNA
  Prss40
ctcccgcgagggagg

SEQ ID NO: 80931 - DNA, 15 bp, Artificial Sequence
  dgRNA
  Hddc3
aaatacctgggctac

SEQ ID NO: 80932 - DNA, 15 bp, Artificial Sequence
  dgRNA
  Hddc3
acgcgcacacacgtt

SEQ ID NO: 80933 - DNA, 15 bp, Artificial Sequence
  dgRNA
  Hddc3
cgcgcacacacgttg

SEQ ID NO: 80934 - DNA, 15 bp, Artificial Sequence
  dgRNA
  Hddc3
gcgcacacacgttgg

SEQ ID NO: 80935 - DNA, 15 bp, Artificial Sequence
  dgRNA
  Fcgbp
ccttggcagatcttc

SEQ ID NO: 80936 - DNA, 15 bp, Artificial Sequence
  dgRNA
  Fcgbp
cacctggtctgagat

SEQ ID NO: 80937 - DNA, 15 bp, Artificial Sequence
  dgRNA
  Fcgbp
caccgtgtgcgcgtc

SEQ ID NO: 80938 - DNA, 15 bp, Artificial Sequence
  dgRNA
  Fcgbp
gcgcgtcaggtgacc

SEQ ID NO: 80939 - DNA, 15 bp, Artificial Sequence
  dgRNA
  Zkscan2
ccctccttgcccgcg

SEQ ID NO: 80940 - DNA, 15 bp, Artificial Sequence
  dgRNA
  Zkscan2
cgaggaagcctcgca

SEQ ID NO: 80941 - DNA, 15 bp, Artificial Sequence
  dgRNA
  Zkscan2
gcctcgcacggaccc

SEQ ID NO: 80942 - DNA, 15 bp, Artificial Sequence
  dgRNA
  Zkscan2
gaccccggtcgcgag

SEQ ID NO: 80943 - DNA, 15 bp, Artificial Sequence
  dgRNA
  Tsga13
tggccagtcagcggg

SEQ ID NO: 80944 - DNA, 15 bp, Artificial Sequence
  dgRNA
  Olfr266
gatgataccaagtaa

SEQ ID NO: 80945 - DNA, 15 bp, Artificial Sequence
  dgRNA
  Snrpn
tccacgcatgcgtga

SEQ ID NO: 80946 - DNA, 15 bp, Artificial Sequence
  dgRNA
  Snrpn
cgcatgcgtgatggg

SEQ ID NO: 80947 - DNA, 15 bp, Artificial Sequence
  dgRNA
  Snrpn
actagcacagactgg

SEQ ID NO: 80948 - DNA, 15 bp, Artificial Sequence
  dgRNA
  Snrpn
cccatcacgcatgcg

SEQ ID NO: 80949 - DNA, 15 bp, Artificial Sequence
  dgRNA
  Slc25a34
tcccctactctagct

SEQ ID NO: 80950 - DNA, 15 bp, Artificial Sequence
  dgRNA
  Slc25a34
gccaagctagagtag

SEQ ID NO: 80951 - DNA, 15 bp, Artificial Sequence
  dgRNA
  Slc25a34
agccaagctagagta

SEQ ID NO: 80952 - DNA, 15 bp, Artificial Sequence
  dgRNA
  Slc25a34
ggccagggcgggcct

SEQ ID NO: 80953 - DNA, 15 bp, Artificial Sequence
  dgRNA
  1700015F17Rik
cttgatcaagtccag

SEQ ID NO: 80954 - DNA, 15 bp, Artificial Sequence
  dgRNA
  1700015F17Rik
cggacaaactgcacg

SEQ ID NO: 80955 - DNA, 15 bp, Artificial Sequence
  dgRNA
  1700015F17Rik
ctgcacgtggtattc

SEQ ID NO: 80956 - DNA, 15 bp, Artificial Sequence
  dgRNA
  1700015F17Rik
tgcacgtggtattca

SEQ ID NO: 80957 - DNA, 15 bp, Artificial Sequence
  dgRNA
  Cav2
ggactgcaagccaag

SEQ ID NO: 80958 - DNA, 15 bp, Artificial Sequence
  dgRNA
  Cav2
gccaagtggcccggg

SEQ ID NO: 80959 - DNA, 15 bp, Artificial Sequence
  dgRNA
  Cav2
cggcttcaccaagcc

SEQ ID NO: 80960 - DNA, 15 bp, Artificial Sequence
  dgRNA
  Cav2
acagattggtcaggg

SEQ ID NO: 80961 - DNA, 15 bp, Artificial Sequence
  dgRNA
  Lrrd1
gctcataaacgccag

SEQ ID NO: 80962 - DNA, 15 bp, Artificial Sequence
  dgRNA
  Lrrd1
ctcataaacgccaga

SEQ ID NO: 80963 - DNA, 15 bp, Artificial Sequence
  dgRNA
  Lrrd1
ataaacgccagaggg

SEQ ID NO: 80964 - DNA, 15 bp, Artificial Sequence
  dgRNA
  Lrrd1
acagacattcgcgcg

SEQ ID NO: 80965 - DNA, 15 bp, Artificial Sequence
  dgRNA
  Dnah5
ctaaacatgattaag

SEQ ID NO: 80966 - DNA, 15 bp, Artificial Sequence
  dgRNA
  Dnah5
agaggcgtgcttaaa

SEQ ID NO: 80967 - DNA, 15 bp, Artificial Sequence
  dgRNA
  Dnah5
ttaaacggcacagca

SEQ ID NO: 80968 - DNA, 15 bp, Artificial Sequence
  dgRNA
  Dnah5
ttaccctaacaacga

SEQ ID NO: 80969 - DNA, 15 bp, Artificial Sequence
  dgRNA
  Dnajc21
caatgactctcggcg

SEQ ID NO: 80970 - DNA, 15 bp, Artificial Sequence
  dgRNA
  Dnajc21
ggcgcgccgctcccc

SEQ ID NO: 80971 - DNA, 15 bp, Artificial Sequence
  dgRNA
  Dnajc21
cagcccccgcccatg

SEQ ID NO: 80972 - DNA, 15 bp, Artificial Sequence
  dgRNA
  Dnajc21
cccatgcggagctgt

SEQ ID NO: 80973 - DNA, 15 bp, Artificial Sequence
  dgRNA
  Izumo4
aaggcttgcgccatc

SEQ ID NO: 80974 - DNA, 15 bp, Artificial Sequence
  dgRNA
  Izumo4
cgccatcaggcccgg

SEQ ID NO: 80975 - DNA, 15 bp, Artificial Sequence
  dgRNA
  Izumo4
gccatcaggcccggt

SEQ ID NO: 80976 - DNA, 15 bp, Artificial Sequence
  dgRNA
  Izumo4
atcaggcccggtggg

SEQ ID NO: 80977 - DNA, 15 bp, Artificial Sequence
  dgRNA
  Elavl1
ccggtgctcaactgc

SEQ ID NO: 80978 - DNA, 15 bp, Artificial Sequence
  dgRNA
  Elavl1
cagaccggaaatgtc

SEQ ID NO: 80979 - DNA, 15 bp, Artificial Sequence
  dgRNA
  Elavl1
agaccggaaatgtcc

SEQ ID NO: 80980 - DNA, 15 bp, Artificial Sequence
  dgRNA
  Elavl1
cggaaatgtccgggc

SEQ ID NO: 80981 - DNA, 15 bp, Artificial Sequence
  dgRNA
  Nek6
gaagggtccacgaat

SEQ ID NO: 80982 - DNA, 15 bp, Artificial Sequence
  dgRNA
  Nek6
ctagagcccgcgcag

SEQ ID NO: 80983 - DNA, 15 bp, Artificial Sequence
  dgRNA
  Nek6
tagagcccgcgcaga

SEQ ID NO: 80984 - DNA, 15 bp, Artificial Sequence
  dgRNA
  Nek6
agagcccgcgcagag

SEQ ID NO: 80985 - DNA, 15 bp, Artificial Sequence
  dgRNA
  Itgb3bp
agcttatctgttgcg

SEQ ID NO: 80986 - DNA, 15 bp, Artificial Sequence
  dgRNA
  Itgb3bp
tatctgttgcgaggc

SEQ ID NO: 80987 - DNA, 15 bp, Artificial Sequence
  dgRNA
  Itgb3bp
atgtccacaatagtg

SEQ ID NO: 80988 - DNA, 15 bp, Artificial Sequence
  dgRNA
  Itgb3bp
gtcgtgcgctgcatg

SEQ ID NO: 80989 - DNA, 15 bp, Artificial Sequence
  dgRNA
  Ugdh
gcctagcgggaccag

SEQ ID NO: 80990 - DNA, 15 bp, Artificial Sequence
  dgRNA
  Ugdh
cagcgccgctcgctg

SEQ ID NO: 80991 - DNA, 15 bp, Artificial Sequence
  dgRNA
  Ugdh
agcgccgctcgctgc

SEQ ID NO: 80992 - DNA, 15 bp, Artificial Sequence
  dgRNA
  Ugdh
cgctcgctgcgggcg

SEQ ID NO: 80993 - DNA, 15 bp, Artificial Sequence
  dgRNA
  Ankib1
ttccgggtcggcccg

SEQ ID NO: 80994 - DNA, 15 bp, Artificial Sequence
  dgRNA
  Ankib1
tccgggtcggcccgc

SEQ ID NO: 80995 - DNA, 15 bp, Artificial Sequence
  dgRNA
  Ankib1
ccgggtcggcccgcg

SEQ ID NO: 80996 - DNA, 15 bp, Artificial Sequence
  dgRNA
  Ankib1
agccgccgttcgtgc

SEQ ID NO: 80997 - DNA, 15 bp, Artificial Sequence
  dgRNA
  Eddm3b
gcaatacactttaca

SEQ ID NO: 80998 - DNA, 15 bp, Artificial Sequence
  dgRNA
  Eddm3b
cccggaaagtttctt

SEQ ID NO: 80999 - DNA, 15 bp, Artificial Sequence
  dgRNA
  Eddm3b
ctaagaaactttccg

SEQ ID NO: 81000 - DNA, 15 bp, Artificial Sequence
  dgRNA
  Mrps22
tttaaaacgcttccg

SEQ ID NO: 81001 - DNA, 15 bp, Artificial Sequence
  dgRNA
  Mrps22
ttgctctatcgattc

SEQ ID NO: 81002 - DNA, 15 bp, Artificial Sequence
  dgRNA
  Mrps22
ggaggcaaggcgccg

SEQ ID NO: 81003 - DNA, 15 bp, Artificial Sequence
  dgRNA
  Mrps22
ttttgtgcagcattc

SEQ ID NO: 81004 - DNA, 15 bp, Artificial Sequence
  dgRNA
  Atp6v0e
acacatcaccaaaat

SEQ ID NO: 81005 - DNA, 15 bp, Artificial Sequence
  dgRNA
  Atp6v0e
ctccccggtggctgg

SEQ ID NO: 81006 - DNA, 15 bp, Artificial Sequence
  dgRNA
  Atp6v0e
ctcagtcaagcccca

SEQ ID NO: 81007 - DNA, 15 bp, Artificial Sequence
  dgRNA
  Atp6v0e
ctagccaggtaaggg

SEQ ID NO: 81008 - DNA, 15 bp, Artificial Sequence
  dgRNA
  Eif5a
cggcggcgctagagg

SEQ ID NO: 81009 - DNA, 15 bp, Artificial Sequence
  dgRNA
  Eif5a
cggcgctagaggcgg

SEQ ID NO: 81010 - DNA, 15 bp, Artificial Sequence
  dgRNA
  Eif5a
gcggcagcacagtag

SEQ ID NO: 81011 - DNA, 15 bp, Artificial Sequence
  dgRNA
  Eif5a
gcacagtagcgggtt

SEQ ID NO: 81012 - DNA, 15 bp, Artificial Sequence
  dgRNA
  Olfr231
agatgacccaattgg

SEQ ID NO: 81013 - DNA, 15 bp, Artificial Sequence
  dgRNA
  Fem1c
ctttccgtagcacgc

SEQ ID NO: 81014 - DNA, 15 bp, Artificial Sequence
  dgRNA
  Fem1c
tctcccttagtacgc

SEQ ID NO: 81015 - DNA, 15 bp, Artificial Sequence
  dgRNA
  Fem1c
caggcgcactctcct

SEQ ID NO: 81016 - DNA, 15 bp, Artificial Sequence
  dgRNA
  Fem1c
ccttggagcgcgcgc

SEQ ID NO: 81017 - DNA, 15 bp, Artificial Sequence
  dgRNA
  Lpcat4
acccgctaagaatcg

SEQ ID NO: 81018 - DNA, 15 bp, Artificial Sequence
  dgRNA
  Lpcat4
cccgctaagaatcga

SEQ ID NO: 81019 - DNA, 15 bp, Artificial Sequence
  dgRNA
  Lpcat4
agggatgcaagcgcg

SEQ ID NO: 81020 - DNA, 15 bp, Artificial Sequence
  dgRNA
  Lpcat4
gggatgcaagcgcgc

SEQ ID NO: 81021 - DNA, 15 bp, Artificial Sequence
  dgRNA
  Csrp3
gaagggttactggtc

SEQ ID NO: 81022 - DNA, 15 bp, Artificial Sequence
  dgRNA
  Csrp3
aacctttcacatcag

SEQ ID NO: 81023 - DNA, 15 bp, Artificial Sequence
  dgRNA
  Csrp3
gttcaactcaccatg

SEQ ID NO: 81024 - DNA, 15 bp, Artificial Sequence
  dgRNA
  Csrp3
gtaacccttccaggc

SEQ ID NO: 81025 - DNA, 15 bp, Artificial Sequence
  dgRNA
  Pcdhb10
tggcgctgtcgacta

SEQ ID NO: 81026 - DNA, 15 bp, Artificial Sequence
  dgRNA
  Pcdhb10
ggcgctgtcgactaa

SEQ ID NO: 81027 - DNA, 15 bp, Artificial Sequence
  dgRNA
  Pcdhb10
tgagctgaaagtacg

SEQ ID NO: 81028 - DNA, 15 bp, Artificial Sequence
  dgRNA
  Cox20
cgagacaggaaccgg

SEQ ID NO: 81029 - DNA, 15 bp, Artificial Sequence
  dgRNA
  Cox20
cggtggcgcttctct

SEQ ID NO: 81030 - DNA, 15 bp, Artificial Sequence
  dgRNA
  Cox20
cactcgcgttcctca

SEQ ID NO: 81031 - DNA, 15 bp, Artificial Sequence
  dgRNA
  Cox20
cgcgttcctcatggt

SEQ ID NO: 81032 - DNA, 15 bp, Artificial Sequence
  dgRNA
  Rsph3b
gccgccaccaacatc

SEQ ID NO: 81033 - DNA, 15 bp, Artificial Sequence
  dgRNA
  Rsph3b
ccgccaccaacatct

SEQ ID NO: 81034 - DNA, 15 bp, Artificial Sequence
  dgRNA
  Rsph3b
ttactacagaccctt

SEQ ID NO: 81035 - DNA, 15 bp, Artificial Sequence
  dgRNA
  Rsph3b
ttcgggaaacccagc

SEQ ID NO: 81036 - DNA, 15 bp, Artificial Sequence
  dgRNA
  Adora3
acagtttgctgtaag

SEQ ID NO: 81037 - DNA, 15 bp, Artificial Sequence
  dgRNA
  Adora3
cttcacggtgctaca

SEQ ID NO: 81038 - DNA, 15 bp, Artificial Sequence
  dgRNA
  Adora3
gctacatggactttt

SEQ ID NO: 81039 - DNA, 15 bp, Artificial Sequence
  dgRNA
  Adora3
ccttttgtgatgact

SEQ ID NO: 81040 - DNA, 15 bp, Artificial Sequence
  dgRNA
  2-Sep
cgcgcgcgctctact

SEQ ID NO: 81041 - DNA, 15 bp, Artificial Sequence
  dgRNA
  2-Sep
gcgcgctctactggg

SEQ ID NO: 81042 - DNA, 15 bp, Artificial Sequence
  dgRNA
  2-Sep
gcgctctactgggcg

SEQ ID NO: 81043 - DNA, 15 bp, Artificial Sequence
  dgRNA
  2-Sep
tctactgggcggggc

SEQ ID NO: 81044 - DNA, 15 bp, Artificial Sequence
  dgRNA
  Blnk
cacacagcatacgat

SEQ ID NO: 81045 - DNA, 15 bp, Artificial Sequence
  dgRNA
  Blnk
acacagcatacgata

SEQ ID NO: 81046 - DNA, 15 bp, Artificial Sequence
  dgRNA
  Blnk
ctatcgtatgctgtg

SEQ ID NO: 81047 - DNA, 15 bp, Artificial Sequence
  dgRNA
  Blnk
gtcaaggtcacttag

SEQ ID NO: 81048 - DNA, 15 bp, Artificial Sequence
  dgRNA
  Twist1
gttagaccccgagca

SEQ ID NO: 81049 - DNA, 15 bp, Artificial Sequence
  dgRNA
  Twist1
ttagaccccgagcaa

SEQ ID NO: 81050 - DNA, 15 bp, Artificial Sequence
  dgRNA
  Twist1
tagaccccgagcaag

SEQ ID NO: 81051 - DNA, 15 bp, Artificial Sequence
  dgRNA
  Twist1
agaccccgagcaagg

SEQ ID NO: 81052 - DNA, 15 bp, Artificial Sequence
  dgRNA
  Cd37
ctatggacacctgcg

SEQ ID NO: 81053 - DNA, 15 bp, Artificial Sequence
  dgRNA
  Cd37
aacccattgtgtccc

SEQ ID NO: 81054 - DNA, 15 bp, Artificial Sequence
  dgRNA
  Cd37
ctgctgtgcactcga

SEQ ID NO: 81055 - DNA, 15 bp, Artificial Sequence
  dgRNA
  Cd37
agtcactaaatgaac

SEQ ID NO: 81056 - DNA, 15 bp, Artificial Sequence
  dgRNA
  Synpo2l
cccttcgcatcatgc

SEQ ID NO: 81057 - DNA, 15 bp, Artificial Sequence
  dgRNA
  Synpo2l
ccttcgcatcatgct

SEQ ID NO: 81058 - DNA, 15 bp, Artificial Sequence
  dgRNA
  Synpo2l
tctatgcaatggctc

SEQ ID NO: 81059 - DNA, 15 bp, Artificial Sequence
  dgRNA
  Synpo2l
cacaccaagagttgt

SEQ ID NO: 81060 - DNA, 15 bp, Artificial Sequence
  dgRNA
  Derl1
caggacgtcgagtcc

SEQ ID NO: 81061 - DNA, 15 bp, Artificial Sequence
  dgRNA
  Derl1
ctgcaaaaacggcac

SEQ ID NO: 81062 - DNA, 15 bp, Artificial Sequence
  dgRNA
  Derl1
ggccctttaagccgc

SEQ ID NO: 81063 - DNA, 15 bp, Artificial Sequence
  dgRNA
  Derl1
gccctttaagccgcc

SEQ ID NO: 81064 - DNA, 15 bp, Artificial Sequence
  dgRNA
  Igdcc4
gtggccacactggcg

SEQ ID NO: 81065 - DNA, 15 bp, Artificial Sequence
  dgRNA
  Igdcc4
cggggcgcccccgcg

SEQ ID NO: 81066 - DNA, 15 bp, Artificial Sequence
  dgRNA
  Igdcc4
ggggcgcccccgcgt

SEQ ID NO: 81067 - DNA, 15 bp, Artificial Sequence
  dgRNA
  Igdcc4
gccgctagcccaaga

SEQ ID NO: 81068 - DNA, 15 bp, Artificial Sequence
  dgRNA
  1700019N19Rik
gaccgggcaaacatc

SEQ ID NO: 81069 - DNA, 15 bp, Artificial Sequence
  dgRNA
  1700019N19Rik
catctggacttccgc

SEQ ID NO: 81070 - DNA, 15 bp, Artificial Sequence
  dgRNA
  1700019N19Rik
agcggctaagtttac

SEQ ID NO: 81071 - DNA, 15 bp, Artificial Sequence
  dgRNA
  1700019N19Rik
gcggctaagtttact

SEQ ID NO: 81072 - DNA, 15 bp, Artificial Sequence
  dgRNA
  Usp34
cccttcccccgccgc

SEQ ID NO: 81073 - DNA, 15 bp, Artificial Sequence
  dgRNA
  Usp34
gcctaggcgcccctg

SEQ ID NO: 81074 - DNA, 15 bp, Artificial Sequence
  dgRNA
  Usp34
gcccgctcccgctcc

SEQ ID NO: 81075 - DNA, 15 bp, Artificial Sequence
  dgRNA
  Usp34
cgctcccgggcccgc

SEQ ID NO: 81076 - DNA, 15 bp, Artificial Sequence
  dgRNA
  Vmn1r77
tggcttaatatatag

SEQ ID NO: 81077 - DNA, 15 bp, Artificial Sequence
  dgRNA
  Vmn1r77
atgatttagagaccc

SEQ ID NO: 81078 - DNA, 15 bp, Artificial Sequence
  dgRNA
  Tmem135
tatatagcccgaccc

SEQ ID NO: 81079 - DNA, 15 bp, Artificial Sequence
  dgRNA
  Tmem135
atagcccgacccagg

SEQ ID NO: 81080 - DNA, 15 bp, Artificial Sequence
  dgRNA
  Tmem135
tagcccgacccaggc

SEQ ID NO: 81081 - DNA, 15 bp, Artificial Sequence
  dgRNA
  Tmem135
ccaccatcacgctcc

SEQ ID NO: 81082 - DNA, 15 bp, Artificial Sequence
  dgRNA
  Hmg20a
gtgtctcaccttgcg

SEQ ID NO: 81083 - DNA, 15 bp, Artificial Sequence
  dgRNA
  Hmg20a
agtccttcgccgcat

SEQ ID NO: 81084 - DNA, 15 bp, Artificial Sequence
  dgRNA
  Hmg20a
gtccttcgccgcatt

SEQ ID NO: 81085 - DNA, 15 bp, Artificial Sequence
  dgRNA
  Hmg20a
cgaatggctgactta

SEQ ID NO: 81086 - DNA, 15 bp, Artificial Sequence
  dgRNA
  Arid5a
ggcgcgactgactac

SEQ ID NO: 81087 - DNA, 15 bp, Artificial Sequence
  dgRNA
  Defb29
acatgaggtgccacc

SEQ ID NO: 81088 - DNA, 15 bp, Artificial Sequence
  dgRNA
  Defb29
ggatgtctcccgccc

SEQ ID NO: 81089 - DNA, 15 bp, Artificial Sequence
  dgRNA
  Defb29
agagttttagccagg

SEQ ID NO: 81090 - DNA, 15 bp, Artificial Sequence
  dgRNA
  Defb29
gacagagttttagcc

SEQ ID NO: 81091 - DNA, 15 bp, Artificial Sequence
  dgRNA
  St6galnac2
ccagccaccggcttc

SEQ ID NO: 81092 - DNA, 15 bp, Artificial Sequence
  dgRNA
  St6galnac2
gcacagtgctcaatc

SEQ ID NO: 81093 - DNA, 15 bp, Artificial Sequence
  dgRNA
  St6galnac2
atccctgcccgactc

SEQ ID NO: 81094 - DNA, 15 bp, Artificial Sequence
  dgRNA
  St6galnac2
tggaataggtacatc

SEQ ID NO: 81095 - DNA, 15 bp, Artificial Sequence
  dgRNA
  Il17a
tgttgcccgtcataa

SEQ ID NO: 81096 - DNA, 15 bp, Artificial Sequence
  dgRNA
  Il17a
gttgcccgtcataaa

SEQ ID NO: 81097 - DNA, 15 bp, Artificial Sequence
  dgRNA
  Il17a
ttgcccgtcataaag

SEQ ID NO: 81098 - DNA, 15 bp, Artificial Sequence
  dgRNA
  Il17a
cccgtcataaagggg

SEQ ID NO: 81099 - DNA, 15 bp, Artificial Sequence
  dgRNA
  Olfr1231
aatgggagcagctac

SEQ ID NO: 81100 - DNA, 15 bp, Artificial Sequence
  dgRNA
  Olfr1231
cagctactgggttaa

SEQ ID NO: 81101 - DNA, 15 bp, Artificial Sequence
  dgRNA
  Olfr1231
tgctgaaagccctgt

SEQ ID NO: 81102 - DNA, 15 bp, Artificial Sequence
  dgRNA
  Hsd17b12
cttaatacggaaatg

SEQ ID NO: 81103 - DNA, 15 bp, Artificial Sequence
  dgRNA
  Hsd17b12
ctctgagcgcgccga

SEQ ID NO: 81104 - DNA, 15 bp, Artificial Sequence
  dgRNA
  Hsd17b12
tctgagcgcgccgaa

SEQ ID NO: 81105 - DNA, 15 bp, Artificial Sequence
  dgRNA
  Hsd17b12
ctgagcgcgccgaag

SEQ ID NO: 81106 - DNA, 15 bp, Artificial Sequence
  dgRNA
  Pcdhb12
ataccgaaacacatc

SEQ ID NO: 81107 - DNA, 15 bp, Artificial Sequence
  dgRNA
  Krtap20-2
gtgctgcaacgcctg

SEQ ID NO: 81108 - DNA, 15 bp, Artificial Sequence
  dgRNA
  Krtap20-2
accctggcatataaa

SEQ ID NO: 81109 - DNA, 15 bp, Artificial Sequence
  dgRNA
  Krtap20-2
agtgttgtcatgtac

SEQ ID NO: 81110 - DNA, 15 bp, Artificial Sequence
  dgRNA
  Krtap20-2
ccagggttattgttg

SEQ ID NO: 81111 - DNA, 15 bp, Artificial Sequence
  dgRNA
  Spry4
tcatagaatcgtgag

SEQ ID NO: 81112 - DNA, 15 bp, Artificial Sequence
  dgRNA
  Spry4
gcaacatcgccgctg

SEQ ID NO: 81113 - DNA, 15 bp, Artificial Sequence
  dgRNA
  Spry4
ctgacagcgcggagc

SEQ ID NO: 81114 - DNA, 15 bp, Artificial Sequence
  dgRNA
  Spry4
gtgcgcgcatgcgct

SEQ ID NO: 81115 - DNA, 15 bp, Artificial Sequence
  dgRNA
  Nxf7
atcggaagactacaa

SEQ ID NO: 81116 - DNA, 15 bp, Artificial Sequence
  dgRNA
  Nxf7
ttcactatcacccac

SEQ ID NO: 81117 - DNA, 15 bp, Artificial Sequence
  dgRNA
  Nxf7
atcactttagtctcc

SEQ ID NO: 81118 - DNA, 15 bp, Artificial Sequence
  dgRNA
  Nxf7
cttccgatgaagctt

SEQ ID NO: 81119 - DNA, 15 bp, Artificial Sequence
  dgRNA
  B9d1
cacagtgcgggtccg

SEQ ID NO: 81120 - DNA, 15 bp, Artificial Sequence
  dgRNA
  B9d1
ccgtggacccgcccc

SEQ ID NO: 81121 - DNA, 15 bp, Artificial Sequence
  dgRNA
  B9d1
cgtggacccgcccct

SEQ ID NO: 81122 - DNA, 15 bp, Artificial Sequence
  dgRNA
  B9d1
gtggacccgcccctg

SEQ ID NO: 81123 - DNA, 15 bp, Artificial Sequence
  dgRNA
  Mapk4
ggtcgcctccgggtc

SEQ ID NO: 81124 - DNA, 15 bp, Artificial Sequence
  dgRNA
  Mapk4
gtcgcctccgggtct

SEQ ID NO: 81125 - DNA, 15 bp, Artificial Sequence
  dgRNA
  Mapk4
ggatggtccccggtg

SEQ ID NO: 81126 - DNA, 15 bp, Artificial Sequence
  dgRNA
  Mapk4
ccccggtgcggttgc

SEQ ID NO: 81127 - DNA, 15 bp, Artificial Sequence
  dgRNA
  Fam63b
cctagcctgaacgcg

SEQ ID NO: 81128 - DNA, 15 bp, Artificial Sequence
  dgRNA
  Fam63b
ctagcctgaacgcgc

SEQ ID NO: 81129 - DNA, 15 bp, Artificial Sequence
  dgRNA
  Fam63b
gcctgaacgcgcggg

SEQ ID NO: 81130 - DNA, 15 bp, Artificial Sequence
  dgRNA
  Fam63b
cctgaacgcgcggga

SEQ ID NO: 81131 - DNA, 15 bp, Artificial Sequence
  dgRNA
  Pkib
agtcctgtaaataag

SEQ ID NO: 81132 - DNA, 15 bp, Artificial Sequence
  dgRNA
  Pkib
taggctcctggtatc

SEQ ID NO: 81133 - DNA, 15 bp, Artificial Sequence
  dgRNA
  Pkib
ttccctcttatttac

SEQ ID NO: 81134 - DNA, 15 bp, Artificial Sequence
  dgRNA
  Gprc5a
tgtgcttctgacgtc

SEQ ID NO: 81135 - DNA, 15 bp, Artificial Sequence
  dgRNA
  Gprc5a
gtgcttctgacgtca

SEQ ID NO: 81136 - DNA, 15 bp, Artificial Sequence
  dgRNA
  Gprc5a
cagcgagaagtgccg

SEQ ID NO: 81137 - DNA, 15 bp, Artificial Sequence
  dgRNA
  Gprc5a
gaagtgccgcggaac

SEQ ID NO: 81138 - DNA, 15 bp, Artificial Sequence
  dgRNA
  Wfdc12
cctccctcaaaatgg

SEQ ID NO: 81139 - DNA, 15 bp, Artificial Sequence
  dgRNA
  Wfdc12
ccaccattttgaggg

SEQ ID NO: 81140 - DNA, 15 bp, Artificial Sequence
  dgRNA
  Wfdc12
tggccaccattttga

SEQ ID NO: 81141 - DNA, 15 bp, Artificial Sequence
  dgRNA
  Wfdc12
ggcgtggcaatgggc

SEQ ID NO: 81142 - DNA, 15 bp, Artificial Sequence
  dgRNA
  Asna1
tccaaatgtcaatgc

SEQ ID NO: 81143 - DNA, 15 bp, Artificial Sequence
  dgRNA
  Asna1
tacgtatttagcacg

SEQ ID NO: 81144 - DNA, 15 bp, Artificial Sequence
  dgRNA
  Asna1
gattcccctgtctcg

SEQ ID NO: 81145 - DNA, 15 bp, Artificial Sequence
  dgRNA
  Asna1
tcctgcattgacatt

SEQ ID NO: 81146 - DNA, 15 bp, Artificial Sequence
  dgRNA
  Ctr9
cggcgcgggtctgtg

SEQ ID NO: 81147 - DNA, 15 bp, Artificial Sequence
  dgRNA
  Ctr9
gtttggacaccttag

SEQ ID NO: 81148 - DNA, 15 bp, Artificial Sequence
  dgRNA
  Ctr9
atgccgcgttcccga

SEQ ID NO: 81149 - DNA, 15 bp, Artificial Sequence
  dgRNA
  Ctr9
gttcccgaaggcgct

SEQ ID NO: 81150 - DNA, 15 bp, Artificial Sequence
  dgRNA
  Eif4ebp3
tgaagtcactcaaat

SEQ ID NO: 81151 - DNA, 15 bp, Artificial Sequence
  dgRNA
  Eif4ebp3
tgtcttcccgtcctg

SEQ ID NO: 81152 - DNA, 15 bp, Artificial Sequence
  dgRNA
  Eif4ebp3
gtcttcccgtcctgt

SEQ ID NO: 81153 - DNA, 15 bp, Artificial Sequence
  dgRNA
  Eif4ebp3
tttcatcataaaacg

SEQ ID NO: 81154 - DNA, 15 bp, Artificial Sequence
  dgRNA
  Foxk2
ctcctcactccgccc

SEQ ID NO: 81155 - DNA, 15 bp, Artificial Sequence
  dgRNA
  Foxk2
ttttccgcgccgccg

SEQ ID NO: 81156 - DNA, 15 bp, Artificial Sequence
  dgRNA
  Foxk2
gtcgcgcgacgacgc

SEQ ID NO: 81157 - DNA, 15 bp, Artificial Sequence
  dgRNA
  Foxk2
acgacgccggacgtg

SEQ ID NO: 81158 - DNA, 15 bp, Artificial Sequence
  dgRNA
  Afm
ctagaaatttgcacc

SEQ ID NO: 81159 - DNA, 15 bp, Artificial Sequence
  dgRNA
  Afm
ccaaaccagcccaca

SEQ ID NO: 81160 - DNA, 15 bp, Artificial Sequence
  dgRNA
  Afm
gtaattattaactag

SEQ ID NO: 81161 - DNA, 15 bp, Artificial Sequence
  dgRNA
  Afm
ggtaattattaacta

SEQ ID NO: 81162 - DNA, 15 bp, Artificial Sequence
  dgRNA
  Adra2c
gaggccttctgccag

SEQ ID NO: 81163 - DNA, 15 bp, Artificial Sequence
  dgRNA
  Adra2c
gagttggcaatccac

SEQ ID NO: 81164 - DNA, 15 bp, Artificial Sequence
  dgRNA
  Adra2c
tagaccggaaaggga

SEQ ID NO: 81165 - DNA, 15 bp, Artificial Sequence
  dgRNA
  Adra2c
atagaccggaaaggg

SEQ ID NO: 81166 - DNA, 15 bp, Artificial Sequence
  dgRNA
  Acp6
gaagactggcgggac

SEQ ID NO: 81167 - DNA, 15 bp, Artificial Sequence
  dgRNA
  Acp6
aagactggcgggact

SEQ ID NO: 81168 - DNA, 15 bp, Artificial Sequence
  dgRNA
  Acp6
ggaacgtgggaggcg

SEQ ID NO: 81169 - DNA, 15 bp, Artificial Sequence
  dgRNA
  Acp6
gaacgtgggaggcgt

SEQ ID NO: 81170 - DNA, 15 bp, Artificial Sequence
  dgRNA
  Exosc4
caaaccaaagacgtc

SEQ ID NO: 81171 - DNA, 15 bp, Artificial Sequence
  dgRNA
  Exosc4
aaaacccgttcgcct

SEQ ID NO: 81172 - DNA, 15 bp, Artificial Sequence
  dgRNA
  Exosc4
aaacccgttcgcctc

SEQ ID NO: 81173 - DNA, 15 bp, Artificial Sequence
  dgRNA
  Exosc4
gggccttccgtttcc

SEQ ID NO: 81174 - DNA, 15 bp, Artificial Sequence
  dgRNA
  Lrrc48
gtcaatcgtttacat

SEQ ID NO: 81175 - DNA, 15 bp, Artificial Sequence
  dgRNA
  Lrrc48
aatcgtttacatagg

SEQ ID NO: 81176 - DNA, 15 bp, Artificial Sequence
  dgRNA
  Lrrc48
atcgtttacataggc

SEQ ID NO: 81177 - DNA, 15 bp, Artificial Sequence
  dgRNA
  Lrrc48
ttcttcaagtctggt

SEQ ID NO: 81178 - DNA, 15 bp, Artificial Sequence
  dgRNA
  Det1
cagtatgcaagaagc

SEQ ID NO: 81179 - DNA, 15 bp, Artificial Sequence
  dgRNA
  Det1
gttatgaacgtgcct

SEQ ID NO: 81180 - DNA, 15 bp, Artificial Sequence
  dgRNA
  Det1
gtgccttggatcact

SEQ ID NO: 81181 - DNA, 15 bp, Artificial Sequence
  dgRNA
  Det1
ttggatcacttggtc

SEQ ID NO: 81182 - DNA, 15 bp, Artificial Sequence
  dgRNA
  Atp5g1
gggactccgaacacg

SEQ ID NO: 81183 - DNA, 15 bp, Artificial Sequence
  dgRNA
  Atp5g1
ggactccgaacacgt

SEQ ID NO: 81184 - DNA, 15 bp, Artificial Sequence
  dgRNA
  Atp5g1
ctccgaacacgtggg

SEQ ID NO: 81185 - DNA, 15 bp, Artificial Sequence
  dgRNA
  Atp5g1
tccgaacacgtgggt

SEQ ID NO: 81186 - DNA, 15 bp, Artificial Sequence
  dgRNA
  3425401B19Rik
gctggaatcgtggtg

SEQ ID NO: 81187 - DNA, 15 bp, Artificial Sequence
  dgRNA
  3425401B19Rik
ctggaatcgtggtga

SEQ ID NO: 81188 - DNA, 15 bp, Artificial Sequence
  dgRNA
  3425401B19Rik
gttatctattactcg

SEQ ID NO: 81189 - DNA, 15 bp, Artificial Sequence
  dgRNA
  3425401B19Rik
tactcgtggctgatc

SEQ ID NO: 81190 - DNA, 15 bp, Artificial Sequence
  dgRNA
  Otol1
ttgttatttgcgagg

SEQ ID NO: 81191 - DNA, 15 bp, Artificial Sequence
  dgRNA
  Otol1
aacttgttatttgcg

SEQ ID NO: 81192 - DNA, 15 bp, Artificial Sequence
  dgRNA
  Hs3st5
tggccgccagggacc

SEQ ID NO: 81193 - DNA, 15 bp, Artificial Sequence
  dgRNA
  Hs3st5
cgcgagccgaagtga

SEQ ID NO: 81194 - DNA, 15 bp, Artificial Sequence
  dgRNA
  Hs3st5
gagccgaagtgatgg

SEQ ID NO: 81195 - DNA, 15 bp, Artificial Sequence
  dgRNA
  Hs3st5
agccgaagtgatgga

SEQ ID NO: 81196 - DNA, 15 bp, Artificial Sequence
  dgRNA
  Cdc26
tctacttttcagacc

SEQ ID NO: 81197 - DNA, 15 bp, Artificial Sequence
  dgRNA
  Cdc26
gcgcgcctagcaaag

SEQ ID NO: 81198 - DNA, 15 bp, Artificial Sequence
  dgRNA
  Cdc26
acgtgcgaagtatct

SEQ ID NO: 81199 - DNA, 15 bp, Artificial Sequence
  dgRNA
  Cdc26
cgtgcgaagtatctt

SEQ ID NO: 81200 - DNA, 15 bp, Artificial Sequence
  dgRNA
  Tubgcp5
gactctcggatttcc

SEQ ID NO: 81201 - DNA, 15 bp, Artificial Sequence
  dgRNA
  Tubgcp5
ctgccggaactctcg

SEQ ID NO: 81202 - DNA, 15 bp, Artificial Sequence
  dgRNA
  Tubgcp5
cacatctcgaaaccc

SEQ ID NO: 81203 - DNA, 15 bp, Artificial Sequence
  dgRNA
  Tubgcp5
tcgaaaccccggtgc

SEQ ID NO: 81204 - DNA, 15 bp, Artificial Sequence
  dgRNA
  Rapgef6
ctggccagtcgcgcg

SEQ ID NO: 81205 - DNA, 15 bp, Artificial Sequence
  dgRNA
  Rapgef6
tggccagtcgcgcgt

SEQ ID NO: 81206 - DNA, 15 bp, Artificial Sequence
  dgRNA
  Rapgef6
gtcgcgcgtgggctg

SEQ ID NO: 81207 - DNA, 15 bp, Artificial Sequence
  dgRNA
  Rapgef6
cagcccacgcgcgac

SEQ ID NO: 81208 - DNA, 15 bp, Artificial Sequence
  dgRNA
  Cd109
ttctgactcatcgtc

SEQ ID NO: 81209 - DNA, 15 bp, Artificial Sequence
  dgRNA
  Cd109
tgactcatcgtctgg

SEQ ID NO: 81210 - DNA, 15 bp, Artificial Sequence
  dgRNA
  Cd109
tggatgccgctcaca

SEQ ID NO: 81211 - DNA, 15 bp, Artificial Sequence
  dgRNA
  Cd109
tgccgctcacaagga

SEQ ID NO: 81212 - DNA, 15 bp, Artificial Sequence
  dgRNA
  Olfr285
tgtctggaccaacag

SEQ ID NO: 81213 - DNA, 15 bp, Artificial Sequence
  dgRNA
  Olfr285
atgaaatttggatcc

SEQ ID NO: 81214 - DNA, 15 bp, Artificial Sequence
  dgRNA
  Olfr285
gcatcgtggaaaagg

SEQ ID NO: 81215 - DNA, 15 bp, Artificial Sequence
  dgRNA
  Olfr285
tagtataccttccct

SEQ ID NO: 81216 - DNA, 15 bp, Artificial Sequence
  dgRNA
  Amica1
acctagatgattgaa

SEQ ID NO: 81217 - DNA, 15 bp, Artificial Sequence
  dgRNA
  Amica1
tggagagccttgatt

SEQ ID NO: 81218 - DNA, 15 bp, Artificial Sequence
  dgRNA
  Amica1
agagccttgattggg

SEQ ID NO: 81219 - DNA, 15 bp, Artificial Sequence
  dgRNA
  Amica1
cgcagccaccacaga

SEQ ID NO: 81220 - DNA, 15 bp, Artificial Sequence
  dgRNA
  Hmgb3
gcccgctggccaatc

SEQ ID NO: 81221 - DNA, 15 bp, Artificial Sequence
  dgRNA
  Hmgb3
gcctgattggccagc

SEQ ID NO: 81222 - DNA, 15 bp, Artificial Sequence
  dgRNA
  Hmgb3
cgcctgattggccag

SEQ ID NO: 81223 - DNA, 15 bp, Artificial Sequence
  dgRNA
  Sra1
ttagaggcacttccg

SEQ ID NO: 81224 - DNA, 15 bp, Artificial Sequence
  dgRNA
  Sra1
ttccggggcatttcg

SEQ ID NO: 81225 - DNA, 15 bp, Artificial Sequence
  dgRNA
  Sra1
tccggggcatttcga

SEQ ID NO: 81226 - DNA, 15 bp, Artificial Sequence
  dgRNA
  Sra1
ccggggcatttcgag

SEQ ID NO: 81227 - DNA, 15 bp, Artificial Sequence
  dgRNA
  Cxcl17
attcccgtaaagacc

SEQ ID NO: 81228 - DNA, 15 bp, Artificial Sequence
  dgRNA
  Cxcl17
tctttacgggaatgt

SEQ ID NO: 81229 - DNA, 15 bp, Artificial Sequence
  dgRNA
  Cxcl17
gtctttacgggaatg

SEQ ID NO: 81230 - DNA, 15 bp, Artificial Sequence
  dgRNA
  Cxcl17
ggaccaggtctttac

SEQ ID NO: 81231 - DNA, 15 bp, Artificial Sequence
  dgRNA
  Ltbp4
tgttggagcacgggt

SEQ ID NO: 81232 - DNA, 15 bp, Artificial Sequence
  dgRNA
  Ltbp4
gtggatggggcctat

SEQ ID NO: 81233 - DNA, 15 bp, Artificial Sequence
  dgRNA
  Ltbp4
agtggatggggccta

SEQ ID NO: 81234 - DNA, 15 bp, Artificial Sequence
  dgRNA
  Ltbp4
tccaacaagtggatg

SEQ ID NO: 81235 - DNA, 15 bp, Artificial Sequence
  dgRNA
  Exo1
taagcaactatgaac

SEQ ID NO: 81236 - DNA, 15 bp, Artificial Sequence
  dgRNA
  Exo1
tagcacgcatgtacc

SEQ ID NO: 81237 - DNA, 15 bp, Artificial Sequence
  dgRNA
  Exo1
tgtacctggatccag

SEQ ID NO: 81238 - DNA, 15 bp, Artificial Sequence
  dgRNA
  Exo1
cgagagcgcaacttc

SEQ ID NO: 81239 - DNA, 15 bp, Artificial Sequence
  dgRNA
  Ankub1
cattgtcaagtgtgc

SEQ ID NO: 81240 - DNA, 15 bp, Artificial Sequence
  dgRNA
  Ankub1
atcacaatagccacc

SEQ ID NO: 81241 - DNA, 15 bp, Artificial Sequence
  dgRNA
  Sod3
cacgaaagacatact

SEQ ID NO: 81242 - DNA, 15 bp, Artificial Sequence
  dgRNA
  Sod3
ctttcgtgacttccc

SEQ ID NO: 81243 - DNA, 15 bp, Artificial Sequence
  dgRNA
  Hmg20b
ccagtcgcctccgat

SEQ ID NO: 81244 - DNA, 15 bp, Artificial Sequence
  dgRNA
  Hmg20b
cggcgtgctgtgggg

SEQ ID NO: 81245 - DNA, 15 bp, Artificial Sequence
  dgRNA
  Hmg20b
tggcggcgtgctgtg

SEQ ID NO: 81246 - DNA, 15 bp, Artificial Sequence
  dgRNA
  Hmg20b
ctggcggcgtgctgt

SEQ ID NO: 81247 - DNA, 15 bp, Artificial Sequence
  dgRNA
  Arpc5
tcacgtgatgctccc

SEQ ID NO: 81248 - DNA, 15 bp, Artificial Sequence
  dgRNA
  Arpc5
gggcccgcgcgtgcg

SEQ ID NO: 81249 - DNA, 15 bp, Artificial Sequence
  dgRNA
  Arpc5
cgacgcgcgctcccg

SEQ ID NO: 81250 - DNA, 15 bp, Artificial Sequence
  dgRNA
  Arpc5
cgctcccgggggacg

SEQ ID NO: 81251 - DNA, 15 bp, Artificial Sequence
  dgRNA
  Sspn
aatgcctctatagac

SEQ ID NO: 81252 - DNA, 15 bp, Artificial Sequence
  dgRNA
  Sspn
ctatagactggactg

SEQ ID NO: 81253 - DNA, 15 bp, Artificial Sequence
  dgRNA
  Sspn
tatagactggactgg

SEQ ID NO: 81254 - DNA, 15 bp, Artificial Sequence
  dgRNA
  Sspn
ctgggggtaaaccta

SEQ ID NO: 81255 - DNA, 15 bp, Artificial Sequence
  dgRNA
  Anxa5
gtgcaagacgctgtg

SEQ ID NO: 81256 - DNA, 15 bp, Artificial Sequence
  dgRNA
  Anxa5
cgaaaagccccacgc

SEQ ID NO: 81257 - DNA, 15 bp, Artificial Sequence
  dgRNA
  Anxa5
gccccacgcaggcgc

SEQ ID NO: 81258 - DNA, 15 bp, Artificial Sequence
  dgRNA
  Anxa5
ggcgcaggagcatag

SEQ ID NO: 81259 - DNA, 15 bp, Artificial Sequence
  dgRNA
  Olfr1380
actgaatgctattta

SEQ ID NO: 81260 - DNA, 15 bp, Artificial Sequence
  dgRNA
  Ribc1
cgaggttagcccgcg

SEQ ID NO: 81261 - DNA, 15 bp, Artificial Sequence
  dgRNA
  Ribc1
gaggttagcccgcgc

SEQ ID NO: 81262 - DNA, 15 bp, Artificial Sequence
  dgRNA
  Ribc1
tagcgcagtgcaagc

SEQ ID NO: 81263 - DNA, 15 bp, Artificial Sequence
  dgRNA
  Ribc1
agcgcagtgcaagcc

SEQ ID NO: 81264 - DNA, 15 bp, Artificial Sequence
  dgRNA
  Fabp9
tgaattaaactttgc

SEQ ID NO: 81265 - DNA, 15 bp, Artificial Sequence
  dgRNA
  Fabp9
aaatgagtcaaccgc

SEQ ID NO: 81266 - DNA, 15 bp, Artificial Sequence
  dgRNA
  Fabp9
tcaaccgccggtgcc

SEQ ID NO: 81267 - DNA, 15 bp, Artificial Sequence
  dgRNA
  Fabp9
cccattggttgcttc

SEQ ID NO: 81268 - DNA, 15 bp, Artificial Sequence
  dgRNA
  Hook1
cacacccgcttcgcc

SEQ ID NO: 81269 - DNA, 15 bp, Artificial Sequence
  dgRNA
  Hook1
acccgcttcgcctgg

SEQ ID NO: 81270 - DNA, 15 bp, Artificial Sequence
  dgRNA
  Hook1
cttcgcctggcggtc

SEQ ID NO: 81271 - DNA, 15 bp, Artificial Sequence
  dgRNA
  Hook1
ttcgcctggcggtcc

SEQ ID NO: 81272 - DNA, 15 bp, Artificial Sequence
  dgRNA
  Gpd1l
tctgcgcaataacat

SEQ ID NO: 81273 - DNA, 15 bp, Artificial Sequence
  dgRNA
  Gpd1l
acattggcctgcacg

SEQ ID NO: 81274 - DNA, 15 bp, Artificial Sequence
  dgRNA
  Gpd1l
tgcacgtggcccgcc

SEQ ID NO: 81275 - DNA, 15 bp, Artificial Sequence
  dgRNA
  Gpd1l
ccgcctggaactgaa

SEQ ID NO: 81276 - DNA, 15 bp, Artificial Sequence
  dgRNA
  Plpp1
cccggcctgttggag

SEQ ID NO: 81277 - DNA, 15 bp, Artificial Sequence
  dgRNA
  Plpp1
ccggcctgttggaga

SEQ ID NO: 81278 - DNA, 15 bp, Artificial Sequence
  dgRNA
  Plpp1
gcagcggagggcgat

SEQ ID NO: 81279 - DNA, 15 bp, Artificial Sequence
  dgRNA
  Plpp1
tgtgccctctccaac

SEQ ID NO: 81280 - DNA, 15 bp, Artificial Sequence
  dgRNA
  Metrnl
ctgcggcgtgacacc

SEQ ID NO: 81281 - DNA, 15 bp, Artificial Sequence
  dgRNA
  Metrnl
tgcggcgtgacacca

SEQ ID NO: 81282 - DNA, 15 bp, Artificial Sequence
  dgRNA
  Metrnl
acaccagggcgttcc

SEQ ID NO: 81283 - DNA, 15 bp, Artificial Sequence
  dgRNA
  Metrnl
tgtgagctggcgcac

SEQ ID NO: 81284 - DNA, 15 bp, Artificial Sequence
  dgRNA
  Psg22
acgtgagaaagatgt

SEQ ID NO: 81285 - DNA, 15 bp, Artificial Sequence
  dgRNA
  Psg22
aacaacaactcatcc

SEQ ID NO: 81286 - DNA, 15 bp, Artificial Sequence
  dgRNA
  Lrch4
cagtggggactacgg

SEQ ID NO: 81287 - DNA, 15 bp, Artificial Sequence
  dgRNA
  Lrch4
actacggcggctccg

SEQ ID NO: 81288 - DNA, 15 bp, Artificial Sequence
  dgRNA
  Lrch4
acggcggctccgagg

SEQ ID NO: 81289 - DNA, 15 bp, Artificial Sequence
  dgRNA
  Lrch4
cggcggctccgagga

SEQ ID NO: 81290 - DNA, 15 bp, Artificial Sequence
  dgRNA
  Emcn
atccccaaaataagt

SEQ ID NO: 81291 - DNA, 15 bp, Artificial Sequence
  dgRNA
  Emcn
cgcactccctttggg

SEQ ID NO: 81292 - DNA, 15 bp, Artificial Sequence
  dgRNA
  Emcn
acacgcactcccttt

SEQ ID NO: 81293 - DNA, 15 bp, Artificial Sequence
  dgRNA
  Emcn
tacacgcactccctt

SEQ ID NO: 81294 - DNA, 15 bp, Artificial Sequence
  dgRNA
  Ncald
agtccgcacagtcaa

SEQ ID NO: 81295 - DNA, 15 bp, Artificial Sequence
  dgRNA
  Meiob
cgtgcgtgagacccg

SEQ ID NO: 81296 - DNA, 15 bp, Artificial Sequence
  dgRNA
  Meiob
gagacccgcggccat

SEQ ID NO: 81297 - DNA, 15 bp, Artificial Sequence
  dgRNA
  Meiob
agacccgcggccata

SEQ ID NO: 81298 - DNA, 15 bp, Artificial Sequence
  dgRNA
  Meiob
gacccgcggccatag

SEQ ID NO: 81299 - DNA, 15 bp, Artificial Sequence
  dgRNA
  Map1a
ccagtagccaagcag

SEQ ID NO: 81300 - DNA, 15 bp, Artificial Sequence
  dgRNA
  Map1a
tctagtgcctcgtca

SEQ ID NO: 81301 - DNA, 15 bp, Artificial Sequence
  dgRNA
  Map1a
tcagttcaaagagcc

SEQ ID NO: 81302 - DNA, 15 bp, Artificial Sequence
  dgRNA
  Map1a
acagtctgaatgatc

SEQ ID NO: 81303 - DNA, 15 bp, Artificial Sequence
  dgRNA
  Fancm
ttctgatttccggaa

SEQ ID NO: 81304 - DNA, 15 bp, Artificial Sequence
  dgRNA
  Fancm
ttcccgccgcaaaat

SEQ ID NO: 81305 - DNA, 15 bp, Artificial Sequence
  dgRNA
  Fancm
ccgccgcaaaatcgg

SEQ ID NO: 81306 - DNA, 15 bp, Artificial Sequence
  dgRNA
  Fancm
ccgcaaaatcggcgg

SEQ ID NO: 81307 - DNA, 15 bp, Artificial Sequence
  dgRNA
  Pls3
cccaccacagaccga

SEQ ID NO: 81308 - DNA, 15 bp, Artificial Sequence
  dgRNA
  Pls3
ccaccacagaccgaa

SEQ ID NO: 81309 - DNA, 15 bp, Artificial Sequence
  dgRNA
  Pls3
tacccagattcccta

SEQ ID NO: 81310 - DNA, 15 bp, Artificial Sequence
  dgRNA
  Pls3
cgaccacccctgaag

SEQ ID NO: 81311 - DNA, 15 bp, Artificial Sequence
  dgRNA
  1700030J22Rik
agctctcgaagcgtc

SEQ ID NO: 81312 - DNA, 15 bp, Artificial Sequence
  dgRNA
  1700030J22Rik
aagcgtctggcaacg

SEQ ID NO: 81313 - DNA, 15 bp, Artificial Sequence
  dgRNA
  1700030J22Rik
ccacgcacagagcga

SEQ ID NO: 81314 - DNA, 15 bp, Artificial Sequence
  dgRNA
  1700030J22Rik
cacgcacagagcgac

SEQ ID NO: 81315 - DNA, 15 bp, Artificial Sequence
  dgRNA
  Slc25a28
cgcttccaagatcaa

SEQ ID NO: 81316 - DNA, 15 bp, Artificial Sequence
  dgRNA
  Slc25a28
tttggctccgtaaaa

SEQ ID NO: 81317 - DNA, 15 bp, Artificial Sequence
  dgRNA
  Slc25a28
ttggctccgtaaaaa

SEQ ID NO: 81318 - DNA, 15 bp, Artificial Sequence
  dgRNA
  Slc25a28
tggctccgtaaaaag

SEQ ID NO: 81319 - DNA, 15 bp, Artificial Sequence
  dgRNA
  Abcb4
ggcagtcacttttag

SEQ ID NO: 81320 - DNA, 15 bp, Artificial Sequence
  dgRNA
  Abcb4
cccgtagcctgccag

SEQ ID NO: 81321 - DNA, 15 bp, Artificial Sequence
  dgRNA
  Abcb4
atcgagcaggcttat

SEQ ID NO: 81322 - DNA, 15 bp, Artificial Sequence
  dgRNA
  Abcb4
cttatcggctgcagc

SEQ ID NO: 81323 - DNA, 15 bp, Artificial Sequence
  dgRNA
  Man2b1
tcagtctactgccac

SEQ ID NO: 81324 - DNA, 15 bp, Artificial Sequence
  dgRNA
  Man2b1
ggtccttgatgaccc

SEQ ID NO: 81325 - DNA, 15 bp, Artificial Sequence
  dgRNA
  Man2b1
ttcctcaccgattgg

SEQ ID NO: 81326 - DNA, 15 bp, Artificial Sequence
  dgRNA
  Man2b1
caccgattggcggtt

SEQ ID NO: 81327 - DNA, 15 bp, Artificial Sequence
  dgRNA
  Dlgap3
cgacctcggtcctcg

SEQ ID NO: 81328 - DNA, 15 bp, Artificial Sequence
  dgRNA
  Dlgap3
gacctcggtcctcgc

SEQ ID NO: 81329 - DNA, 15 bp, Artificial Sequence
  dgRNA
  Dlgap3
acctcggtcctcgcg

SEQ ID NO: 81330 - DNA, 15 bp, Artificial Sequence
  dgRNA
  Dlgap3
tcgcggggccgctgc

SEQ ID NO: 81331 - DNA, 15 bp, Artificial Sequence
  dgRNA
  Bco1
aagcaccggtcagct

SEQ ID NO: 81332 - DNA, 15 bp, Artificial Sequence
  dgRNA
  Bco1
agcaccggtcagctt

SEQ ID NO: 81333 - DNA, 15 bp, Artificial Sequence
  dgRNA
  Bco1
cggtcagcttgggga

SEQ ID NO: 81334 - DNA, 15 bp, Artificial Sequence
  dgRNA
  Bco1
agagacggagtgtac

SEQ ID NO: 81335 - DNA, 15 bp, Artificial Sequence
  dgRNA
  Cdc37
cgactcccgttgcta

SEQ ID NO: 81336 - DNA, 15 bp, Artificial Sequence
  dgRNA
  Cdc37
gtcccgcgccgacgc

SEQ ID NO: 81337 - DNA, 15 bp, Artificial Sequence
  dgRNA
  Cdc37
tcccgcgccgacgct

SEQ ID NO: 81338 - DNA, 15 bp, Artificial Sequence
  dgRNA
  Cdc37
cccgcgccgacgctg

SEQ ID NO: 81339 - DNA, 15 bp, Artificial Sequence
  dgRNA
  Yars2
gatagaggaacagcg

SEQ ID NO: 81340 - DNA, 15 bp, Artificial Sequence
  dgRNA
  Yars2
atagaggaacagcgg

SEQ ID NO: 81341 - DNA, 15 bp, Artificial Sequence
  dgRNA
  Yars2
gcgggggccgcaaga

SEQ ID NO: 81342 - DNA, 15 bp, Artificial Sequence
  dgRNA
  Yars2
aagacggaactcagt

SEQ ID NO: 81343 - DNA, 15 bp, Artificial Sequence
  dgRNA
  Olfr1278
actacagactttagt

SEQ ID NO: 81344 - DNA, 15 bp, Artificial Sequence
  dgRNA
  Fam19a2
agtctccgtgacagc

SEQ ID NO: 81345 - DNA, 15 bp, Artificial Sequence
  dgRNA
  Fam19a2
cagatttaccgctag

SEQ ID NO: 81346 - DNA, 15 bp, Artificial Sequence
  dgRNA
  Fam19a2
agatttaccgctaga

SEQ ID NO: 81347 - DNA, 15 bp, Artificial Sequence
  dgRNA
  Fam19a2
ctttgccggctgtca

SEQ ID NO: 81348 - DNA, 15 bp, Artificial Sequence
  dgRNA
  Acadvl
tttagtttagaccag

SEQ ID NO: 81349 - DNA, 15 bp, Artificial Sequence
  dgRNA
  Acadvl
cggctctatagagtt

SEQ ID NO: 81350 - DNA, 15 bp, Artificial Sequence
  dgRNA
  Acadvl
ggctctatagagttt

SEQ ID NO: 81351 - DNA, 15 bp, Artificial Sequence
  dgRNA
  Acadvl
cggatcgtttgaaga

SEQ ID NO: 81352 - DNA, 15 bp, Artificial Sequence
  dgRNA
  Mcf2
acaagctaatccaca

SEQ ID NO: 81353 - DNA, 15 bp, Artificial Sequence
  dgRNA
  Mcf2
ccacaaggttcaatc

SEQ ID NO: 81354 - DNA, 15 bp, Artificial Sequence
  dgRNA
  Mcf2
tcaggctaagtagtt

SEQ ID NO: 81355 - DNA, 15 bp, Artificial Sequence
  dgRNA
  Mcf2
caggctaagtagtta

SEQ ID NO: 81356 - DNA, 15 bp, Artificial Sequence
  dgRNA
  Sowahd
cagaatgtagacgcc

SEQ ID NO: 81357 - DNA, 15 bp, Artificial Sequence
  dgRNA
  Sowahd
atgtagacgcctggc

SEQ ID NO: 81358 - DNA, 15 bp, Artificial Sequence
  dgRNA
  Sowahd
acgcctggccggtgc

SEQ ID NO: 81359 - DNA, 15 bp, Artificial Sequence
  dgRNA
  Sowahd
cgcctggccggtgca

SEQ ID NO: 81360 - DNA, 15 bp, Artificial Sequence
  dgRNA
  Unc45a
ccgcgcgccctctac

SEQ ID NO: 81361 - DNA, 15 bp, Artificial Sequence
  dgRNA
  Unc45a
gacccaaccacttct

SEQ ID NO: 81362 - DNA, 15 bp, Artificial Sequence
  dgRNA
  Unc45a
ctccgtccccgacca

SEQ ID NO: 81363 - DNA, 15 bp, Artificial Sequence
  dgRNA
  Unc45a
cggaagaggctctaa

SEQ ID NO: 81364 - DNA, 15 bp, Artificial Sequence
  dgRNA
  Slc39a10
gactggcacggtcgc

SEQ ID NO: 81365 - DNA, 15 bp, Artificial Sequence
  dgRNA
  Slc39a10
actggcacggtcgct

SEQ ID NO: 81366 - DNA, 15 bp, Artificial Sequence
  dgRNA
  Slc39a10
cggtcgctgggacag

SEQ ID NO: 81367 - DNA, 15 bp, Artificial Sequence
  dgRNA
  Slc39a10
ggtcgctgggacaga

SEQ ID NO: 81368 - DNA, 15 bp, Artificial Sequence
  dgRNA
  Olfr655
agataggactgaaac

SEQ ID NO: 81369 - DNA, 15 bp, Artificial Sequence
  dgRNA
  Olfr655
acacccatgtctcat

SEQ ID NO: 81370 - DNA, 15 bp, Artificial Sequence
  dgRNA
  Olfr655
ccatgtctcattggc

SEQ ID NO: 81371 - DNA, 15 bp, Artificial Sequence
  dgRNA
  Olfr655
ctgccaatgagacat

SEQ ID NO: 81372 - DNA, 15 bp, Artificial Sequence
  dgRNA
  Setd8
gagcgagaggtctcc

SEQ ID NO: 81373 - DNA, 15 bp, Artificial Sequence
  dgRNA
  Setd8
agcgagaggtctcct

SEQ ID NO: 81374 - DNA, 15 bp, Artificial Sequence
  dgRNA
  Setd8
gcgagaggtctcctg

SEQ ID NO: 81375 - DNA, 15 bp, Artificial Sequence
  dgRNA
  Setd8
ctggttggcatgtcc

SEQ ID NO: 81376 - DNA, 15 bp, Artificial Sequence
  dgRNA
  B3gnt2
ccgaagaggccagat

SEQ ID NO: 81377 - DNA, 15 bp, Artificial Sequence
  dgRNA
  B3gnt2
ataggcaccaccctc

SEQ ID NO: 81378 - DNA, 15 bp, Artificial Sequence
  dgRNA
  B3gnt2
gggcatctatctagg

SEQ ID NO: 81379 - DNA, 15 bp, Artificial Sequence
  dgRNA
  B3gnt2
gtacgctgagagcaa

SEQ ID NO: 81380 - DNA, 15 bp, Artificial Sequence
  dgRNA
  9530053A07Rik
caatggtgtggcccg

SEQ ID NO: 81381 - DNA, 15 bp, Artificial Sequence
  dgRNA
  9530053A07Rik
aatggtgtggcccga

SEQ ID NO: 81382 - DNA, 15 bp, Artificial Sequence
  dgRNA
  9530053A07Rik
cctgaagtcttgtga

SEQ ID NO: 81383 - DNA, 15 bp, Artificial Sequence
  dgRNA
  9530053A07Rik
tgatatcaggccaga

SEQ ID NO: 81384 - DNA, 15 bp, Artificial Sequence
  dgRNA
  Calb2
gtgcgcgcccccttc

SEQ ID NO: 81385 - DNA, 15 bp, Artificial Sequence
  dgRNA
  Calb2
cgcgcccccttccgg

SEQ ID NO: 81386 - DNA, 15 bp, Artificial Sequence
  dgRNA
  Calb2
tccggcggcccgacg

SEQ ID NO: 81387 - DNA, 15 bp, Artificial Sequence
  dgRNA
  Calb2
gacgcggcgcagctc

SEQ ID NO: 81388 - DNA, 15 bp, Artificial Sequence
  dgRNA
  Btn1a1
atatatcgttctctt

SEQ ID NO: 81389 - DNA, 15 bp, Artificial Sequence
  dgRNA
  Btn1a1
tatatcgttctctta

SEQ ID NO: 81390 - DNA, 15 bp, Artificial Sequence
  dgRNA
  Btn1a1
atatcgttctcttag

SEQ ID NO: 81391 - DNA, 15 bp, Artificial Sequence
  dgRNA
  Btn1a1
tcgttctcttagggg

SEQ ID NO: 81392 - DNA, 15 bp, Artificial Sequence
  dgRNA
  Aspg
gatcacaagtgagac

SEQ ID NO: 81393 - DNA, 15 bp, Artificial Sequence
  dgRNA
  Aspg
tgtctagactgggac

SEQ ID NO: 81394 - DNA, 15 bp, Artificial Sequence
  dgRNA
  Aspg
cctgactgggcattc

SEQ ID NO: 81395 - DNA, 15 bp, Artificial Sequence
  dgRNA
  Aspg
ggcctgagttaggta

SEQ ID NO: 81396 - DNA, 15 bp, Artificial Sequence
  dgRNA
  Taldo1
ctaaccactcgctac

SEQ ID NO: 81397 - DNA, 15 bp, Artificial Sequence
  dgRNA
  Taldo1
taaccactcgctact

SEQ ID NO: 81398 - DNA, 15 bp, Artificial Sequence
  dgRNA
  Taldo1
aaccactcgctactg

SEQ ID NO: 81399 - DNA, 15 bp, Artificial Sequence
  dgRNA
  Taldo1
actccgaccgtgaca

SEQ ID NO: 81400 - DNA, 15 bp, Artificial Sequence
  dgRNA
  Tas2r138
gacaacatcccctcc

SEQ ID NO: 81401 - DNA, 15 bp, Artificial Sequence
  dgRNA
  Tas2r138
ttcctattggggatt

SEQ ID NO: 81402 - DNA, 15 bp, Artificial Sequence
  dgRNA
  Tas2r138
ggatttgggttcata

SEQ ID NO: 81403 - DNA, 15 bp, Artificial Sequence
  dgRNA
  Tas2r138
gatttgggttcataa

SEQ ID NO: 81404 - DNA, 15 bp, Artificial Sequence
  dgRNA
  Zfp184
catttgtggaaacct

SEQ ID NO: 81405 - DNA, 15 bp, Artificial Sequence
  dgRNA
  Zfp184
ctgcgcgttgcattc

SEQ ID NO: 81406 - DNA, 15 bp, Artificial Sequence
  dgRNA
  Zfp184
tgcgcgttgcattct

SEQ ID NO: 81407 - DNA, 15 bp, Artificial Sequence
  dgRNA
  Zfp184
ttgtgttccccggtg

SEQ ID NO: 81408 - DNA, 15 bp, Artificial Sequence
  dgRNA
  Unc13c
cccttgaccttccac

SEQ ID NO: 81409 - DNA, 15 bp, Artificial Sequence
  dgRNA
  Unc13c
tggcgctcctgtgga

SEQ ID NO: 81410 - DNA, 15 bp, Artificial Sequence
  dgRNA
  Unc13c
tggatggcgctcctg

SEQ ID NO: 81411 - DNA, 15 bp, Artificial Sequence
  dgRNA
  Unc13c
tagtctgtaaaccca

SEQ ID NO: 81412 - DNA, 15 bp, Artificial Sequence
  dgRNA
  Lpin2
ccgcgtccccgctcg

SEQ ID NO: 81413 - DNA, 15 bp, Artificial Sequence
  dgRNA
  Lpin2
cggcctcgcctcgcg

SEQ ID NO: 81414 - DNA, 15 bp, Artificial Sequence
  dgRNA
  Lpin2
ggcctcgcctcgcgt

SEQ ID NO: 81415 - DNA, 15 bp, Artificial Sequence
  dgRNA
  Lpin2
tgggccacgtagccg

SEQ ID NO: 81416 - DNA, 15 bp, Artificial Sequence
  dgRNA
  Mat1a
ggctgaaattcctca

SEQ ID NO: 81417 - DNA, 15 bp, Artificial Sequence
  dgRNA
  Mat1a
tatataggagtcacc

SEQ ID NO: 81418 - DNA, 15 bp, Artificial Sequence
  dgRNA
  Mat1a
tttagcctctcggac

SEQ ID NO: 81419 - DNA, 15 bp, Artificial Sequence
  dgRNA
  Mat1a
gaggagtccatttcc

SEQ ID NO: 81420 - DNA, 15 bp, Artificial Sequence
  dgRNA
  Gcnt2
acattctgtaacacc

SEQ ID NO: 81421 - DNA, 15 bp, Artificial Sequence
  dgRNA
  Gcnt2
cattctgtaacacca

SEQ ID NO: 81422 - DNA, 15 bp, Artificial Sequence
  dgRNA
  Gcnt2
ccagagtacgaggag

SEQ ID NO: 81423 - DNA, 15 bp, Artificial Sequence
  dgRNA
  Gcnt2
ccggtcagatccctt

SEQ ID NO: 81424 - DNA, 15 bp, Artificial Sequence
  dgRNA
  Pcdhgc3
tcttcgtgcagttat

SEQ ID NO: 81425 - DNA, 15 bp, Artificial Sequence
  dgRNA
  Pcdhgc3
cgtgcagttattggc

SEQ ID NO: 81426 - DNA, 15 bp, Artificial Sequence
  dgRNA
  Pcdhgc3
gtgcagttattggct

SEQ ID NO: 81427 - DNA, 15 bp, Artificial Sequence
  dgRNA
  Pcdhgc3
tctgtgtgccgctgt

SEQ ID NO: 81428 - DNA, 15 bp, Artificial Sequence
  dgRNA
  Zfp282
tatatagaacatagg

SEQ ID NO: 81429 - DNA, 15 bp, Artificial Sequence
  dgRNA
  Zfp282
ttaggaactaatgcc

SEQ ID NO: 81430 - DNA, 15 bp, Artificial Sequence
  dgRNA
  Zfp282
ctatataaatagggt

SEQ ID NO: 81431 - DNA, 15 bp, Artificial Sequence
  dgRNA
  Zfp282
tctatataaataggg

SEQ ID NO: 81432 - DNA, 15 bp, Artificial Sequence
  dgRNA
  Fndc5
gtgaagagcggggac

SEQ ID NO: 81433 - DNA, 15 bp, Artificial Sequence
  dgRNA
  Fndc5
gccctctccccgcag

SEQ ID NO: 81434 - DNA, 15 bp, Artificial Sequence
  dgRNA
  Fndc5
ctctccccgcagcgg

SEQ ID NO: 81435 - DNA, 15 bp, Artificial Sequence
  dgRNA
  Fndc5
cccaggcgcccgacg

SEQ ID NO: 81436 - DNA, 15 bp, Artificial Sequence
  dgRNA
  Cd83
gcatgacccactcga

SEQ ID NO: 81437 - DNA, 15 bp, Artificial Sequence
  dgRNA
  Cd83
catgacccactcgat

SEQ ID NO: 81438 - DNA, 15 bp, Artificial Sequence
  dgRNA
  Cd83
cactcgatgggtttg

SEQ ID NO: 81439 - DNA, 15 bp, Artificial Sequence
  dgRNA
  Cd83
actcgatgggtttga

SEQ ID NO: 81440 - DNA, 15 bp, Artificial Sequence
  dgRNA
  Pcdhac1
ccagaccagcgttag

SEQ ID NO: 81441 - DNA, 15 bp, Artificial Sequence
  dgRNA
  Pcdhac1
cagcccgggcgagcg

SEQ ID NO: 81442 - DNA, 15 bp, Artificial Sequence
  dgRNA
  Pcdhac1
ctctgcacccctagg

SEQ ID NO: 81443 - DNA, 15 bp, Artificial Sequence
  dgRNA
  Pcdhac1
ggggcggaacgccag

SEQ ID NO: 81444 - DNA, 15 bp, Artificial Sequence
  dgRNA
  Setmar
ctagtttaaaacagt

SEQ ID NO: 81445 - DNA, 15 bp, Artificial Sequence
  dgRNA
  Setmar
accccaacgacgctg

SEQ ID NO: 81446 - DNA, 15 bp, Artificial Sequence
  dgRNA
  Setmar
ccccaacgacgctga

SEQ ID NO: 81447 - DNA, 15 bp, Artificial Sequence
  dgRNA
  Setmar
caacgacgctgaggg

SEQ ID NO: 81448 - DNA, 15 bp, Artificial Sequence
  dgRNA
  Vmn1r14
gaataagtttaatcc

SEQ ID NO: 81449 - DNA, 15 bp, Artificial Sequence
  dgRNA
  Vmn1r14
tgttgtgaactaact

SEQ ID NO: 81450 - DNA, 15 bp, Artificial Sequence
  dgRNA
  Vmn1r14
gtgttgtgaactaac

SEQ ID NO: 81451 - DNA, 15 bp, Artificial Sequence
  dgRNA
  Vmn1r14
cgtaaagagatgaag

SEQ ID NO: 81452 - DNA, 15 bp, Artificial Sequence
  dgRNA
  Phf12
ccaatcgcagtacgc

SEQ ID NO: 81453 - DNA, 15 bp, Artificial Sequence
  dgRNA
  Phf12
cagtacgccggcgca

SEQ ID NO: 81454 - DNA, 15 bp, Artificial Sequence
  dgRNA
  Phf12
tacgccggcgcacgg

SEQ ID NO: 81455 - DNA, 15 bp, Artificial Sequence
  dgRNA
  Phf12
cggcgcacggcggag

SEQ ID NO: 81456 - DNA, 15 bp, Artificial Sequence
  dgRNA
  Lrrc14b
ccaaactggtaccta

SEQ ID NO: 81457 - DNA, 15 bp, Artificial Sequence
  dgRNA
  Lrrc14b
tttgttgtccgaagt

SEQ ID NO: 81458 - DNA, 15 bp, Artificial Sequence
  dgRNA
  Lrrc14b
ttttgttgtccgaag

SEQ ID NO: 81459 - DNA, 15 bp, Artificial Sequence
  dgRNA
  Lrrc14b
cttatggcaccctgc

SEQ ID NO: 81460 - DNA, 15 bp, Artificial Sequence
  dgRNA
  Olfr1344
accataaagaggcac

SEQ ID NO: 81461 - DNA, 15 bp, Artificial Sequence
  dgRNA
  Olfr1344
cataaagaggcacgg

SEQ ID NO: 81462 - DNA, 15 bp, Artificial Sequence
  dgRNA
  Olfr1344
taaagaggcacgggg

SEQ ID NO: 81463 - DNA, 15 bp, Artificial Sequence
  dgRNA
  Olfr1344
atgtaacttaagagt

SEQ ID NO: 81464 - DNA, 15 bp, Artificial Sequence
  dgRNA
  Pxmp2
gctccggggagaatt

SEQ ID NO: 81465 - DNA, 15 bp, Artificial Sequence
  dgRNA
  Pxmp2
ccacgtgctctcgcg

SEQ ID NO: 81466 - DNA, 15 bp, Artificial Sequence
  dgRNA
  Pxmp2
gctctcgcgaggcta

SEQ ID NO: 81467 - DNA, 15 bp, Artificial Sequence
  dgRNA
  Pxmp2
gcgaggctacggctt

SEQ ID NO: 81468 - DNA, 15 bp, Artificial Sequence
  dgRNA
  Krt72
ccccaatgacccaaa

SEQ ID NO: 81469 - DNA, 15 bp, Artificial Sequence
  dgRNA
  Krt72
cccaatgacccaaaa

SEQ ID NO: 81470 - DNA, 15 bp, Artificial Sequence
  dgRNA
  Krt72
agcaggactatttaa

SEQ ID NO: 81471 - DNA, 15 bp, Artificial Sequence
  dgRNA
  Krt72
gcaggactatttaag

SEQ ID NO: 81472 - DNA, 15 bp, Artificial Sequence
  dgRNA
  Neurl1a
gagcttggctatttc

SEQ ID NO: 81473 - DNA, 15 bp, Artificial Sequence
  dgRNA
  Neurl1a
gctggttcaggcaaa

SEQ ID NO: 81474 - DNA, 15 bp, Artificial Sequence
  dgRNA
  Gpr161
gagaagccgcaacca

SEQ ID NO: 81475 - DNA, 15 bp, Artificial Sequence
  dgRNA
  Gpr161
ccttagcttgggcct

SEQ ID NO: 81476 - DNA, 15 bp, Artificial Sequence
  dgRNA
  Gpr161
cctcggaatgtttaa

SEQ ID NO: 81477 - DNA, 15 bp, Artificial Sequence
  dgRNA
  Gpr161
ctcggaatgtttaac

SEQ ID NO: 81478 - DNA, 15 bp, Artificial Sequence
  dgRNA
  Scn8a
gcgtgcccgggagca

SEQ ID NO: 81479 - DNA, 15 bp, Artificial Sequence
  dgRNA
  Scn8a
ctcttgtcattgacc

SEQ ID NO: 81480 - DNA, 15 bp, Artificial Sequence
  dgRNA
  Scn8a
ccgcagagcatctat

SEQ ID NO: 81481 - DNA, 15 bp, Artificial Sequence
  dgRNA
  Scn8a
cgcagagcatctatc

SEQ ID NO: 81482 - DNA, 15 bp, Artificial Sequence
  dgRNA
  Tmem30c
ttctaacggaaaaac

SEQ ID NO: 81483 - DNA, 15 bp, Artificial Sequence
  dgRNA
  Tmem30c
gcactcacattatga

SEQ ID NO: 81484 - DNA, 15 bp, Artificial Sequence
  dgRNA
  Tmem30c
acagcctatctgttc

SEQ ID NO: 81485 - DNA, 15 bp, Artificial Sequence
  dgRNA
  Tubb6
ctctgcccgacgccc

SEQ ID NO: 81486 - DNA, 15 bp, Artificial Sequence
  dgRNA
  Tubb6
tctgcccgacgccca

SEQ ID NO: 81487 - DNA, 15 bp, Artificial Sequence
  dgRNA
  Tubb6
tcaggaccaagagcg

SEQ ID NO: 81488 - DNA, 15 bp, Artificial Sequence
  dgRNA
  Tubb6
accaagagcggggct

SEQ ID NO: 81489 - DNA, 15 bp, Artificial Sequence
  dgRNA
  Degs1
gtactccacccactg

SEQ ID NO: 81490 - DNA, 15 bp, Artificial Sequence
  dgRNA
  Degs1
cttcgtgagcctaca

SEQ ID NO: 81491 - DNA, 15 bp, Artificial Sequence
  dgRNA
  Degs1
cttggctgccgaccc

SEQ ID NO: 81492 - DNA, 15 bp, Artificial Sequence
  dgRNA
  Degs1
ccatcgcctcccacg

SEQ ID NO: 81493 - DNA, 15 bp, Artificial Sequence
  dgRNA
  Esrrb
gaacggaaactttcg

SEQ ID NO: 81494 - DNA, 15 bp, Artificial Sequence
  dgRNA
  Esrrb
gattgttgactgcac

SEQ ID NO: 81495 - DNA, 15 bp, Artificial Sequence
  dgRNA
  Esrrb
gccctgacgaccaac

SEQ ID NO: 81496 - DNA, 15 bp, Artificial Sequence
  dgRNA
  Esrrb
ccctgacgaccaacc

SEQ ID NO: 81497 - DNA, 15 bp, Artificial Sequence
  dgRNA
  Slc30a10
gatctgtagtagccc

SEQ ID NO: 81498 - DNA, 15 bp, Artificial Sequence
  dgRNA
  Slc30a10
tctgtagtagcccag

SEQ ID NO: 81499 - DNA, 15 bp, Artificial Sequence
  dgRNA
  Slc30a10
cgctgataaggacct

SEQ ID NO: 81500 - DNA, 15 bp, Artificial Sequence
  dgRNA
  Slc30a10
tgtatgccgctgata

SEQ ID NO: 81501 - DNA, 15 bp, Artificial Sequence
  dgRNA
  Vps25
ccggaagccccttgt

SEQ ID NO: 81502 - DNA, 15 bp, Artificial Sequence
  dgRNA
  Vps25
ccgacaaggggcttc

SEQ ID NO: 81503 - DNA, 15 bp, Artificial Sequence
  dgRNA
  Zbtb3
tcgacgcctgagcaa

SEQ ID NO: 81504 - DNA, 15 bp, Artificial Sequence
  dgRNA
  Zbtb3
cgcctgagcaatggc

SEQ ID NO: 81505 - DNA, 15 bp, Artificial Sequence
  dgRNA
  Zbtb3
cccatttggagaagc

SEQ ID NO: 81506 - DNA, 15 bp, Artificial Sequence
  dgRNA
  Zbtb3
agaagccggttatcg

SEQ ID NO: 81507 - DNA, 15 bp, Artificial Sequence
  dgRNA
  Fabp6
taaggtgaataacct

SEQ ID NO: 81508 - DNA, 15 bp, Artificial Sequence
  dgRNA
  Fabp6
actccctgctagggc

SEQ ID NO: 81509 - DNA, 15 bp, Artificial Sequence
  dgRNA
  Fabp6
ggagtgtttataagc

SEQ ID NO: 81510 - DNA, 15 bp, Artificial Sequence
  dgRNA
  Fabp6
gagtgtttataagct

SEQ ID NO: 81511 - DNA, 15 bp, Artificial Sequence
  dgRNA
  Chchd1
tggcagccgcggaca

SEQ ID NO: 81512 - DNA, 15 bp, Artificial Sequence
  dgRNA
  Chchd1
ggcagccgcggacac

SEQ ID NO: 81513 - DNA, 15 bp, Artificial Sequence
  dgRNA
  Chchd1
gcagccgcggacacg

SEQ ID NO: 81514 - DNA, 15 bp, Artificial Sequence
  dgRNA
  Chchd1
gtcccgagcacgcaa

SEQ ID NO: 81515 - DNA, 15 bp, Artificial Sequence
  dgRNA
  Por
cccagagtccgggct

SEQ ID NO: 81516 - DNA, 15 bp, Artificial Sequence
  dgRNA
  Por
agtccgggctaggcc

SEQ ID NO: 81517 - DNA, 15 bp, Artificial Sequence
  dgRNA
  Por
gtccgggctaggcct

SEQ ID NO: 81518 - DNA, 15 bp, Artificial Sequence
  dgRNA
  Por
ctaggcctgggagcg

SEQ ID NO: 81519 - DNA, 15 bp, Artificial Sequence
  dgRNA
  Ephx4
gcgattctcacatcc

SEQ ID NO: 81520 - DNA, 15 bp, Artificial Sequence
  dgRNA
  Ephx4
ctcacatccgggaaa

SEQ ID NO: 81521 - DNA, 15 bp, Artificial Sequence
  dgRNA
  Ephx4
aaggtctgcggcttc

SEQ ID NO: 81522 - DNA, 15 bp, Artificial Sequence
  dgRNA
  Ephx4
aggtctgcggcttct

SEQ ID NO: 81523 - DNA, 15 bp, Artificial Sequence
  dgRNA
  Zbtb26
cgcagcccgattccc

SEQ ID NO: 81524 - DNA, 15 bp, Artificial Sequence
  dgRNA
  Zbtb26
gccccgcccacaacg

SEQ ID NO: 81525 - DNA, 15 bp, Artificial Sequence
  dgRNA
  Zbtb26
cggaaagtccctctc

SEQ ID NO: 81526 - DNA, 15 bp, Artificial Sequence
  dgRNA
  Zbtb26
tccgagcattccgat

SEQ ID NO: 81527 - DNA, 15 bp, Artificial Sequence
  dgRNA
  Cd82
ttcaaggtcgcagga

SEQ ID NO: 81528 - DNA, 15 bp, Artificial Sequence
  dgRNA
  Cd82
tcaaggtcgcaggaa

SEQ ID NO: 81529 - DNA, 15 bp, Artificial Sequence
  dgRNA
  Cd82
gtctaagaccacaag

SEQ ID NO: 81530 - DNA, 15 bp, Artificial Sequence
  dgRNA
  Cd82
tcttcggtgtgactt

SEQ ID NO: 81531 - DNA, 15 bp, Artificial Sequence
  dgRNA
  Aurkb
ggagcgtgcacatct

SEQ ID NO: 81532 - DNA, 15 bp, Artificial Sequence
  dgRNA
  Aurkb
gagcgtgcacatctt

SEQ ID NO: 81533 - DNA, 15 bp, Artificial Sequence
  dgRNA
  Aurkb
cgtagccaatgagag

SEQ ID NO: 81534 - DNA, 15 bp, Artificial Sequence
  dgRNA
  Aurkb
gtagccaatgagagt

SEQ ID NO: 81535 - DNA, 15 bp, Artificial Sequence
  dgRNA
  Tpbg
catttatctccgcct

SEQ ID NO: 81536 - DNA, 15 bp, Artificial Sequence
  dgRNA
  Tpbg
atttatctccgccta

SEQ ID NO: 81537 - DNA, 15 bp, Artificial Sequence
  dgRNA
  Tpbg
tttatctccgcctag

SEQ ID NO: 81538 - DNA, 15 bp, Artificial Sequence
  dgRNA
  Tpbg
ggagtcgcccagcct

SEQ ID NO: 81539 - DNA, 15 bp, Artificial Sequence
  dgRNA
  Nfkb1
cagcgcgtggggacc

SEQ ID NO: 81540 - DNA, 15 bp, Artificial Sequence
  dgRNA
  Nfkb1
caggccggtctcccg

SEQ ID NO: 81541 - DNA, 15 bp, Artificial Sequence
  dgRNA
  Nfkb1
gtccgggcctgccct

SEQ ID NO: 81542 - DNA, 15 bp, Artificial Sequence
  dgRNA
  Nfkb1
tccgggcctgccctt

SEQ ID NO: 81543 - DNA, 15 bp, Artificial Sequence
  dgRNA
  Aggf1
cggaagtaaaaacac

SEQ ID NO: 81544 - DNA, 15 bp, Artificial Sequence
  dgRNA
  Aggf1
acacaggccgttgtt

SEQ ID NO: 81545 - DNA, 15 bp, Artificial Sequence
  dgRNA
  Aggf1
cacaggccgttgttt

SEQ ID NO: 81546 - DNA, 15 bp, Artificial Sequence
  dgRNA
  Aggf1
gagtttgagtccgat

SEQ ID NO: 81547 - DNA, 15 bp, Artificial Sequence
  dgRNA
  Lce3e
gccatcaaaatttcc

SEQ ID NO: 81548 - DNA, 15 bp, Artificial Sequence
  dgRNA
  Lce3e
aggccggcctagtaa

SEQ ID NO: 81549 - DNA, 15 bp, Artificial Sequence
  dgRNA
  Lce3e
ccttttatccttggc

SEQ ID NO: 81550 - DNA, 15 bp, Artificial Sequence
  dgRNA
  Cryba4
gtccttccccactaa

SEQ ID NO: 81551 - DNA, 15 bp, Artificial Sequence
  dgRNA
  Cryba4
ggtcagggctcttat

SEQ ID NO: 81552 - DNA, 15 bp, Artificial Sequence
  dgRNA
  Cryba4
gaaccagacaaggtc

SEQ ID NO: 81553 - DNA, 15 bp, Artificial Sequence
  dgRNA
  Olfr32
aggtctcttgactac

SEQ ID NO: 81554 - DNA, 15 bp, Artificial Sequence
  dgRNA
  Dusp2
accccctgtccgctc

SEQ ID NO: 81555 - DNA, 15 bp, Artificial Sequence
  dgRNA
  Dusp2
ccccctgtccgctca

SEQ ID NO: 81556 - DNA, 15 bp, Artificial Sequence
  dgRNA
  Dusp2
tcccacgtgaagccg

SEQ ID NO: 81557 - DNA, 15 bp, Artificial Sequence
  dgRNA
  Dusp2
cccacgtgaagccgc

SEQ ID NO: 81558 - DNA, 15 bp, Artificial Sequence
  dgRNA
  Casq1
ttagacaggaccagg

SEQ ID NO: 81559 - DNA, 15 bp, Artificial Sequence
  dgRNA
  Casq1
ggggtgccagtttca

SEQ ID NO: 81560 - DNA, 15 bp, Artificial Sequence
  dgRNA
  Casq1
ggtgccagtttcaag

SEQ ID NO: 81561 - DNA, 15 bp, Artificial Sequence
  dgRNA
  Casq1
taaccttctgaggcc

SEQ ID NO: 81562 - DNA, 15 bp, Artificial Sequence
  dgRNA
  Snai1
cgcgcggtccggtcc

SEQ ID NO: 81563 - DNA, 15 bp, Artificial Sequence
  dgRNA
  Snai1
gcggtccggtccggg

SEQ ID NO: 81564 - DNA, 15 bp, Artificial Sequence
  dgRNA
  Snai1
cgggaggagcccaag

SEQ ID NO: 81565 - DNA, 15 bp, Artificial Sequence
  dgRNA
  Snai1
aatctcagcgccacg

SEQ ID NO: 81566 - DNA, 15 bp, Artificial Sequence
  dgRNA
  Bdnf
atcattttaaatgcg

SEQ ID NO: 81567 - DNA, 15 bp, Artificial Sequence
  dgRNA
  Bdnf
gcggaattctgattc

SEQ ID NO: 81568 - DNA, 15 bp, Artificial Sequence
  dgRNA
  Bdnf
agagtgtctatttcg

SEQ ID NO: 81569 - DNA, 15 bp, Artificial Sequence
  dgRNA
  Bdnf
tctatttcgaggcag

SEQ ID NO: 81570 - DNA, 15 bp, Artificial Sequence
  dgRNA
  Tbx4
gacttataaaccgtg

SEQ ID NO: 81571 - DNA, 15 bp, Artificial Sequence
  dgRNA
  Tbx4
ttagctgcaagtcta

SEQ ID NO: 81572 - DNA, 15 bp, Artificial Sequence
  dgRNA
  Tbx4
tttagctgcaagtct

SEQ ID NO: 81573 - DNA, 15 bp, Artificial Sequence
  dgRNA
  Tbx4
cgtgcctggagggcg

SEQ ID NO: 81574 - DNA, 15 bp, Artificial Sequence
  dgRNA
  Gm853
tctttaatccgattt

SEQ ID NO: 81575 - DNA, 15 bp, Artificial Sequence
  dgRNA
  Gm853
actctggccctaaat

SEQ ID NO: 81576 - DNA, 15 bp, Artificial Sequence
  dgRNA
  Nsun5
tgtttcccgcgcgct

SEQ ID NO: 81577 - DNA, 15 bp, Artificial Sequence
  dgRNA
  Nsun5
gtgagccagcccgct

SEQ ID NO: 81578 - DNA, 15 bp, Artificial Sequence
  dgRNA
  Nsun5
cgaaccctttgactc

SEQ ID NO: 81579 - DNA, 15 bp, Artificial Sequence
  dgRNA
  Nsun5
ttgactccggaaatc

SEQ ID NO: 81580 - DNA, 15 bp, Artificial Sequence
  dgRNA
  Pik3cb
gggattggccctaga

SEQ ID NO: 81581 - DNA, 15 bp, Artificial Sequence
  dgRNA
  Pik3cb
attggccctagaggg

SEQ ID NO: 81582 - DNA, 15 bp, Artificial Sequence
  dgRNA
  Pik3cb
ttggccctagagggt

SEQ ID NO: 81583 - DNA, 15 bp, Artificial Sequence
  dgRNA
  Pik3cb
gcgctcgcgcaggcg

SEQ ID NO: 81584 - DNA, 15 bp, Artificial Sequence
  dgRNA
  Gm9994
aggaaaaaatacggt

SEQ ID NO: 81585 - DNA, 15 bp, Artificial Sequence
  dgRNA
  Sval1
gggtgagtatccagc

SEQ ID NO: 81586 - DNA, 15 bp, Artificial Sequence
  dgRNA
  Sval1
ggtctagtcagttaa

SEQ ID NO: 81587 - DNA, 15 bp, Artificial Sequence
  dgRNA
  H2afb2
cactgatgatgtagc

SEQ ID NO: 81588 - DNA, 15 bp, Artificial Sequence
  dgRNA
  Klk1b27
gggcatattgtacag

SEQ ID NO: 81589 - DNA, 15 bp, Artificial Sequence
  dgRNA
  Klk1b27
tacagagggtacaac

SEQ ID NO: 81590 - DNA, 15 bp, Artificial Sequence
  dgRNA
  Fbxo45
agatccgaaccccgc

SEQ ID NO: 81591 - DNA, 15 bp, Artificial Sequence
  dgRNA
  Fbxo45
aacagcctcatacct

SEQ ID NO: 81592 - DNA, 15 bp, Artificial Sequence
  dgRNA
  Fbxo45
atcccatcaagcttt

SEQ ID NO: 81593 - DNA, 15 bp, Artificial Sequence
  dgRNA
  Fbxo45
tcccatcaagcttta

SEQ ID NO: 81594 - DNA, 15 bp, Artificial Sequence
  dgRNA
  4933406J08Rik
tcttaagccccgccc

SEQ ID NO: 81595 - DNA, 15 bp, Artificial Sequence
  dgRNA
  4933406J08Rik
ggcgggaaaggcctc

SEQ ID NO: 81596 - DNA, 15 bp, Artificial Sequence
  dgRNA
  4933406J08Rik
gatgaggccgctgat

SEQ ID NO: 81597 - DNA, 15 bp, Artificial Sequence
  dgRNA
  4933406J08Rik
gcggggcttaagatg

SEQ ID NO: 81598 - DNA, 15 bp, Artificial Sequence
  dgRNA
  Satb2
cctccttcattgcgg

SEQ ID NO: 81599 - DNA, 15 bp, Artificial Sequence
  dgRNA
  Satb2
tgcggtggaccagtc

SEQ ID NO: 81600 - DNA, 15 bp, Artificial Sequence
  dgRNA
  Satb2
gcgacccaaggagcc

SEQ ID NO: 81601 - DNA, 15 bp, Artificial Sequence
  dgRNA
  Satb2
ggcgacccaaggagc

SEQ ID NO: 81602 - DNA, 15 bp, Artificial Sequence
  dgRNA
  E2f8
gggcggtgccagcta

SEQ ID NO: 81603 - DNA, 15 bp, Artificial Sequence
  dgRNA
  E2f8
tttttaaatcgaagg

SEQ ID NO: 81604 - DNA, 15 bp, Artificial Sequence
  dgRNA
  E2f8
taaatcgaaggcgga

SEQ ID NO: 81605 - DNA, 15 bp, Artificial Sequence
  dgRNA
  E2f8
cgaaggcggaaggtc

SEQ ID NO: 81606 - DNA, 15 bp, Artificial Sequence
  dgRNA
  Dus2
cggaacgcgcaccac

SEQ ID NO: 81607 - DNA, 15 bp, Artificial Sequence
  dgRNA
  Dus2
cgcgcaccactggca

SEQ ID NO: 81608 - DNA, 15 bp, Artificial Sequence
  dgRNA
  Dus2
gaaccgcgcaccact

SEQ ID NO: 81609 - DNA, 15 bp, Artificial Sequence
  dgRNA
  Dus2
cactaggttccgtcg

SEQ ID NO: 81610 - DNA, 15 bp, Artificial Sequence
  dgRNA
  Psmb5
taggtgaacacagac

SEQ ID NO: 81611 - DNA, 15 bp, Artificial Sequence
  dgRNA
  Psmb5
aacacagaccggcgc

SEQ ID NO: 81612 - DNA, 15 bp, Artificial Sequence
  dgRNA
  Psmb5
ggcgctggtatttag

SEQ ID NO: 81613 - DNA, 15 bp, Artificial Sequence
  dgRNA
  Psmb5
tgcccggagtaaaaa

SEQ ID NO: 81614 - DNA, 15 bp, Artificial Sequence
  dgRNA
  Cry1
cccacgcgagaactc

SEQ ID NO: 81615 - DNA, 15 bp, Artificial Sequence
  dgRNA
  Cry1
cccagcgatcgcaac

SEQ ID NO: 81616 - DNA, 15 bp, Artificial Sequence
  dgRNA
  Cry1
ccggtcccgaagcac

SEQ ID NO: 81617 - DNA, 15 bp, Artificial Sequence
  dgRNA
  Cry1
cggtcccgaagcacc

SEQ ID NO: 81618 - DNA, 15 bp, Artificial Sequence
  dgRNA
  Prim2
cttcggtgcgagaca

SEQ ID NO: 81619 - DNA, 15 bp, Artificial Sequence
  dgRNA
  Prim2
catcaaaaagtcggt

SEQ ID NO: 81620 - DNA, 15 bp, Artificial Sequence
  dgRNA
  Prim2
taccgcgccacaccg

SEQ ID NO: 81621 - DNA, 15 bp, Artificial Sequence
  dgRNA
  Prim2
cgcgccacaccgcgg

SEQ ID NO: 81622 - DNA, 15 bp, Artificial Sequence
  dgRNA
  Msi2
cgagcccacgtgtga

SEQ ID NO: 81623 - DNA, 15 bp, Artificial Sequence
  dgRNA
  Msi2
gagcccacgtgtgac

SEQ ID NO: 81624 - DNA, 15 bp, Artificial Sequence
  dgRNA
  Msi2
acgggctctcgccgc

SEQ ID NO: 81625 - DNA, 15 bp, Artificial Sequence
  dgRNA
  Msi2
ctctcgccgctggcc

SEQ ID NO: 81626 - DNA, 15 bp, Artificial Sequence
  dgRNA
  Saxo1
tcctaaagccctcca

SEQ ID NO: 81627 - DNA, 15 bp, Artificial Sequence
  dgRNA
  Saxo1
tgtcttgggtctgcc

SEQ ID NO: 81628 - DNA, 15 bp, Artificial Sequence
  dgRNA
  Saxo1
gtctgacctcacagg

SEQ ID NO: 81629 - DNA, 15 bp, Artificial Sequence
  dgRNA
  Saxo1
tagaggactcagtcc

SEQ ID NO: 81630 - DNA, 15 bp, Artificial Sequence
  dgRNA
  Slc7a13
aaactaagcccttac

SEQ ID NO: 81631 - DNA, 15 bp, Artificial Sequence
  dgRNA
  Slc7a13
ggcattcagttgaaa

SEQ ID NO: 81632 - DNA, 15 bp, Artificial Sequence
  dgRNA
  Slc7a13
atagattacctgtaa

SEQ ID NO: 81633 - DNA, 15 bp, Artificial Sequence
  dgRNA
  Slc7a13
aatagattacctgta

SEQ ID NO: 81634 - DNA, 15 bp, Artificial Sequence
  dgRNA
  Olfr1431
tgactctagtgacat

SEQ ID NO: 81635 - DNA, 15 bp, Artificial Sequence
  dgRNA
  Scgb1c1
aagtttacccagacc

SEQ ID NO: 81636 - DNA, 15 bp, Artificial Sequence
  dgRNA
  Scgb1c1
aagtttggcacttct

SEQ ID NO: 81637 - DNA, 15 bp, Artificial Sequence
  dgRNA
  Scgb1c1
ggtatgccccgcccc

SEQ ID NO: 81638 - DNA, 15 bp, Artificial Sequence
  dgRNA
  Scgb1c1
tagtgctagttaaca

SEQ ID NO: 81639 - DNA, 15 bp, Artificial Sequence
  dgRNA
  Ano5
aggccaagtaccacc

SEQ ID NO: 81640 - DNA, 15 bp, Artificial Sequence
  dgRNA
  Nxf1
caccgcccacatcct

SEQ ID NO: 81641 - DNA, 15 bp, Artificial Sequence
  dgRNA
  Nxf1
acatcctggggacgt

SEQ ID NO: 81642 - DNA, 15 bp, Artificial Sequence
  dgRNA
  Nxf1
tcctggggacgtcgg

SEQ ID NO: 81643 - DNA, 15 bp, Artificial Sequence
  dgRNA
  Nxf1
tgtgggcggtgccgc

SEQ ID NO: 81644 - DNA, 15 bp, Artificial Sequence
  dgRNA
  Cenpp
cgaaccaactcgcag

SEQ ID NO: 81645 - DNA, 15 bp, Artificial Sequence
  dgRNA
  Cenpp
accaactcgcagagg

SEQ ID NO: 81646 - DNA, 15 bp, Artificial Sequence
  dgRNA
  Cenpp
aactcgcagaggcgg

SEQ ID NO: 81647 - DNA, 15 bp, Artificial Sequence
  dgRNA
  Cenpp
actcgcagaggcggc

SEQ ID NO: 81648 - DNA, 15 bp, Artificial Sequence
  dgRNA
  Znrf3
gggcgtggctaagaa

SEQ ID NO: 81649 - DNA, 15 bp, Artificial Sequence
  dgRNA
  Znrf3
ggctaagaacggagt

SEQ ID NO: 81650 - DNA, 15 bp, Artificial Sequence
  dgRNA
  Znrf3
gctaagaacggagtc

SEQ ID NO: 81651 - DNA, 15 bp, Artificial Sequence
  dgRNA
  Znrf3
ctaagaacggagtcg

SEQ ID NO: 81652 - DNA, 15 bp, Artificial Sequence
  dgRNA
  Serpinb9b
gctggatagcattct

SEQ ID NO: 81653 - DNA, 15 bp, Artificial Sequence
  dgRNA
  Serpinb9b
tgggcccttagagga

SEQ ID NO: 81654 - DNA, 15 bp, Artificial Sequence
  dgRNA
  Serpinb9b
tgggtgggcccttag

SEQ ID NO: 81655 - DNA, 15 bp, Artificial Sequence
  dgRNA
  Zfp455
cgagcgctttaaagt

SEQ ID NO: 81656 - DNA, 15 bp, Artificial Sequence
  dgRNA
  Zfp455
cttcgcaaagacttc

SEQ ID NO: 81657 - DNA, 15 bp, Artificial Sequence
  dgRNA
  Zfp455
aactgtgccatcacg

SEQ ID NO: 81658 - DNA, 15 bp, Artificial Sequence
  dgRNA
  Zfp455
cacgaggagccatcc

SEQ ID NO: 81659 - DNA, 15 bp, Artificial Sequence
  dgRNA
  Mpped2
tggcaggttcatgag

SEQ ID NO: 81660 - DNA, 15 bp, Artificial Sequence
  dgRNA
  Mpped2
caggttcatgagtgg

SEQ ID NO: 81661 - DNA, 15 bp, Artificial Sequence
  dgRNA
  Mpped2
cagaagacgaccatc

SEQ ID NO: 81662 - DNA, 15 bp, Artificial Sequence
  dgRNA
  Mpped2
agaagacgaccatct

SEQ ID NO: 81663 - DNA, 15 bp, Artificial Sequence
  dgRNA
  Dynlrb1
tgtccgtctccacaa

SEQ ID NO: 81664 - DNA, 15 bp, Artificial Sequence
  dgRNA
  Dynlrb1
caaaggactgtgcgc

SEQ ID NO: 81665 - DNA, 15 bp, Artificial Sequence
  dgRNA
  Dynlrb1
gtgcgcaggctcaga

SEQ ID NO: 81666 - DNA, 15 bp, Artificial Sequence
  dgRNA
  Dynlrb1
tgcgcaggctcagaa

SEQ ID NO: 81667 - DNA, 15 bp, Artificial Sequence
  dgRNA
  Olfr1243
gtagacatcaacctt

SEQ ID NO: 81668 - DNA, 15 bp, Artificial Sequence
  dgRNA
  Olfr1243
tatacgaggactcac

SEQ ID NO: 81669 - DNA, 15 bp, Artificial Sequence
  dgRNA
  Olfr1243
ctctatgttcaccat

SEQ ID NO: 81670 - DNA, 15 bp, Artificial Sequence
  dgRNA
  Olfr1243
gtgcctaaaagtaca

SEQ ID NO: 81671 - DNA, 15 bp, Artificial Sequence
  dgRNA
  Adra2a
cagctagtagccgaa

SEQ ID NO: 81672 - DNA, 15 bp, Artificial Sequence
  dgRNA
  Adra2a
cgctccccactcctt

SEQ ID NO: 81673 - DNA, 15 bp, Artificial Sequence
  dgRNA
  Adra2a
cgtctttccaaaagc

SEQ ID NO: 81674 - DNA, 15 bp, Artificial Sequence
  dgRNA
  Adra2a
aaagccgggtcccag

SEQ ID NO: 81675 - DNA, 15 bp, Artificial Sequence
  dgRNA
  Arrdc5
tagtatgctagaatc

SEQ ID NO: 81676 - DNA, 15 bp, Artificial Sequence
  dgRNA
  Arrdc5
tgctagaatcaggac

SEQ ID NO: 81677 - DNA, 15 bp, Artificial Sequence
  dgRNA
  Arrdc5
gctagaatcaggact

SEQ ID NO: 81678 - DNA, 15 bp, Artificial Sequence
  dgRNA
  Arrdc5
ctagaatcaggactg

SEQ ID NO: 81679 - DNA, 15 bp, Artificial Sequence
  dgRNA
  Athl1
aacgtcactgtagag

SEQ ID NO: 81680 - DNA, 15 bp, Artificial Sequence
  dgRNA
  Athl1
gtagagtggtatctc

SEQ ID NO: 81681 - DNA, 15 bp, Artificial Sequence
  dgRNA
  Athl1
cctagtcctattgcg

SEQ ID NO: 81682 - DNA, 15 bp, Artificial Sequence
  dgRNA
  Athl1
cgcccacctgccacg

SEQ ID NO: 81683 - DNA, 15 bp, Artificial Sequence
  dgRNA
  Sebox
aatttcacaaagtac

SEQ ID NO: 81684 - DNA, 15 bp, Artificial Sequence
  dgRNA
  Sebox
tggtgcacaccaatc

SEQ ID NO: 81685 - DNA, 15 bp, Artificial Sequence
  dgRNA
  Abcb5
acttattctactcag

SEQ ID NO: 81686 - DNA, 15 bp, Artificial Sequence
  dgRNA
  Abcb5
cggtaacatcatata

SEQ ID NO: 81687 - DNA, 15 bp, Artificial Sequence
  dgRNA
  Abcb5
atcactgattatatc

SEQ ID NO: 81688 - DNA, 15 bp, Artificial Sequence
  dgRNA
  Abcb5
atatgatgttaccgt

SEQ ID NO: 81689 - DNA, 15 bp, Artificial Sequence
  dgRNA
  Rnase12
ggcagcacttgcaat

SEQ ID NO: 81690 - DNA, 15 bp, Artificial Sequence
  dgRNA
  Rnase12
gcagcacttgcaatg

SEQ ID NO: 81691 - DNA, 15 bp, Artificial Sequence
  dgRNA
  Rnase12
ttgcaatggggtctt

SEQ ID NO: 81692 - DNA, 15 bp, Artificial Sequence
  dgRNA
  Rnase12
gtgatttaaattagc

SEQ ID NO: 81693 - DNA, 15 bp, Artificial Sequence
  dgRNA
  Gabrq
agggtcccgattctg

SEQ ID NO: 81694 - DNA, 15 bp, Artificial Sequence
  dgRNA
  Gabrq
tcccgattctgcgga

SEQ ID NO: 81695 - DNA, 15 bp, Artificial Sequence
  dgRNA
  Gabrq
tccgccccttttgcc

SEQ ID NO: 81696 - DNA, 15 bp, Artificial Sequence
  dgRNA
  Gabrq
cccgcagcggtccac

SEQ ID NO: 81697 - DNA, 15 bp, Artificial Sequence
  dgRNA
  Dlk2
gaacagcgggtacgc

SEQ ID NO: 81698 - DNA, 15 bp, Artificial Sequence
  dgRNA
  Dlk2
aacagcgggtacgct

SEQ ID NO: 81699 - DNA, 15 bp, Artificial Sequence
  dgRNA
  Dlk2
gcgggtacgctggga

SEQ ID NO: 81700 - DNA, 15 bp, Artificial Sequence
  dgRNA
  Dlk2
ggtccatcctgaaag

SEQ ID NO: 81701 - DNA, 15 bp, Artificial Sequence
  dgRNA
  Agfg2
cgccccctctcgcca

SEQ ID NO: 81702 - DNA, 15 bp, Artificial Sequence
  dgRNA
  Uqcrfs1
aatccctcccgactt

SEQ ID NO: 81703 - DNA, 15 bp, Artificial Sequence
  dgRNA
  Uqcrfs1
cgacttcggttttcc

SEQ ID NO: 81704 - DNA, 15 bp, Artificial Sequence
  dgRNA
  Uqcrfs1
gacttcggttttcct

SEQ ID NO: 81705 - DNA, 15 bp, Artificial Sequence
  dgRNA
  Uqcrfs1
acttcggttttcctg

SEQ ID NO: 81706 - DNA, 15 bp, Artificial Sequence
  dgRNA
  Slc43a1
tctgagaatccgatc

SEQ ID NO: 81707 - DNA, 15 bp, Artificial Sequence
  dgRNA
  Slc43a1
cgatctggtgcctag

SEQ ID NO: 81708 - DNA, 15 bp, Artificial Sequence
  dgRNA
  Slc43a1
gcacggtgtgcccct

SEQ ID NO: 81709 - DNA, 15 bp, Artificial Sequence
  dgRNA
  Slc43a1
tggggggttgtctcc

SEQ ID NO: 81710 - DNA, 15 bp, Artificial Sequence
  dgRNA
  Pgap2
cagagccgaactact

SEQ ID NO: 81711 - DNA, 15 bp, Artificial Sequence
  dgRNA
  Pgap2
agagccgaactacta

SEQ ID NO: 81712 - DNA, 15 bp, Artificial Sequence
  dgRNA
  Pgap2
cccggaccccaaaat

SEQ ID NO: 81713 - DNA, 15 bp, Artificial Sequence
  dgRNA
  Pgap2
ccggaccccaaaatg

SEQ ID NO: 81714 - DNA, 15 bp, Artificial Sequence
  dgRNA
  Olfr1170
agtgatcagcaattt

SEQ ID NO: 81715 - DNA, 15 bp, Artificial Sequence
  dgRNA
  Olfr1170
tacaggttcttacgt

SEQ ID NO: 81716 - DNA, 15 bp, Artificial Sequence
  dgRNA
  Olfr1170
ttacaggttcttacg

SEQ ID NO: 81717 - DNA, 15 bp, Artificial Sequence
  dgRNA
  Olfr1170
atttgcccttgttac

SEQ ID NO: 81718 - DNA, 15 bp, Artificial Sequence
  dgRNA
  Plin2
aggcctcgccccggc

SEQ ID NO: 81719 - DNA, 15 bp, Artificial Sequence
  dgRNA
  Plin2
cttcttgtactgatc

SEQ ID NO: 81720 - DNA, 15 bp, Artificial Sequence
  dgRNA
  Plin2
aggcccccgatattg

SEQ ID NO: 81721 - DNA, 15 bp, Artificial Sequence
  dgRNA
  Plin2
cgatattgtggcacc

SEQ ID NO: 81722 - DNA, 15 bp, Artificial Sequence
  dgRNA
  Gpr75
ttgaaggctctccgc

SEQ ID NO: 81723 - DNA, 15 bp, Artificial Sequence
  dgRNA
  Gpr75
tgtatcagcggtcag

SEQ ID NO: 81724 - DNA, 15 bp, Artificial Sequence
  dgRNA
  Gpr75
gcagccctggcatat

SEQ ID NO: 81725 - DNA, 15 bp, Artificial Sequence
  dgRNA
  Gpr75
actcccactaggctg

SEQ ID NO: 81726 - DNA, 15 bp, Artificial Sequence
  dgRNA
  Znrf3
gtgatactctgtata

SEQ ID NO: 81727 - DNA, 15 bp, Artificial Sequence
  dgRNA
  Mief2
ttgcgcctttaaatc

SEQ ID NO: 81728 - DNA, 15 bp, Artificial Sequence
  dgRNA
  Mief2
tccggagtatgcttg

SEQ ID NO: 81729 - DNA, 15 bp, Artificial Sequence
  dgRNA
  Mief2
ggtttccgccccaga

SEQ ID NO: 81730 - DNA, 15 bp, Artificial Sequence
  dgRNA
  Mief2
cgccccagacggtcc

SEQ ID NO: 81731 - DNA, 15 bp, Artificial Sequence
  dgRNA
  Akap6
caactgggatgtgct

SEQ ID NO: 81732 - DNA, 15 bp, Artificial Sequence
  dgRNA
  Ptf1a
ctcattctgccgcac

SEQ ID NO: 81733 - DNA, 15 bp, Artificial Sequence
  dgRNA
  Ptf1a
ttctgccgcactggc

SEQ ID NO: 81734 - DNA, 15 bp, Artificial Sequence
  dgRNA
  Ptf1a
tctgccgcactggct

SEQ ID NO: 81735 - DNA, 15 bp, Artificial Sequence
  dgRNA
  Ptf1a
cggctgccagtcctg

SEQ ID NO: 81736 - DNA, 15 bp, Artificial Sequence
  dgRNA
  Ganab
agaacgcagagcccg

SEQ ID NO: 81737 - DNA, 15 bp, Artificial Sequence
  dgRNA
  Ganab
aacgcgctcgaccaa

SEQ ID NO: 81738 - DNA, 15 bp, Artificial Sequence
  dgRNA
  Ganab
acgcgctcgaccaat

SEQ ID NO: 81739 - DNA, 15 bp, Artificial Sequence
  dgRNA
  Ganab
aatgggatagacgtc

SEQ ID NO: 81740 - DNA, 15 bp, Artificial Sequence
  dgRNA
  Olfr294
caaaacgtggtaaaa

SEQ ID NO: 81741 - DNA, 15 bp, Artificial Sequence
  dgRNA
  Olfr294
atgggggcagtatct

SEQ ID NO: 81742 - DNA, 15 bp, Artificial Sequence
  dgRNA
  Olfr294
atctaggtagtgtcc

SEQ ID NO: 81743 - DNA, 15 bp, Artificial Sequence
  dgRNA
  Olfr294
tctaggtagtgtcct

SEQ ID NO: 81744 - DNA, 15 bp, Artificial Sequence
  dgRNA
  Spx
attagacctccccag

SEQ ID NO: 81745 - DNA, 15 bp, Artificial Sequence
  dgRNA
  Spx
gacaagctaccctcg

SEQ ID NO: 81746 - DNA, 15 bp, Artificial Sequence
  dgRNA
  Spx
agtttttaaagcccg

SEQ ID NO: 81747 - DNA, 15 bp, Artificial Sequence
  dgRNA
  Spx
gtttttaaagcccgg

SEQ ID NO: 81748 - DNA, 15 bp, Artificial Sequence
  dgRNA
  Ddx41
gcgagcaccgcttgc

SEQ ID NO: 81749 - DNA, 15 bp, Artificial Sequence
  dgRNA
  Ddx41
cgagcaccgcttgca

SEQ ID NO: 81750 - DNA, 15 bp, Artificial Sequence
  dgRNA
  Ddx41
actcctggccgccag

SEQ ID NO: 81751 - DNA, 15 bp, Artificial Sequence
  dgRNA
  Ddx41
ctcctggccgccaga

SEQ ID NO: 81752 - DNA, 15 bp, Artificial Sequence
  dgRNA
  Klf17
tttcccggaccctgc

SEQ ID NO: 81753 - DNA, 15 bp, Artificial Sequence
  dgRNA
  Klf17
ccgcccagtgctcag

SEQ ID NO: 81754 - DNA, 15 bp, Artificial Sequence
  dgRNA
  Klf17
ccccccagtttttat

SEQ ID NO: 81755 - DNA, 15 bp, Artificial Sequence
  dgRNA
  Klf17
cactgggcggagtca

SEQ ID NO: 81756 - DNA, 15 bp, Artificial Sequence
  dgRNA
  Ano3
ctaacagtcaaagag

SEQ ID NO: 81757 - DNA, 15 bp, Artificial Sequence
  dgRNA
  Setdb2
gccacacacctaccg

SEQ ID NO: 81758 - DNA, 15 bp, Artificial Sequence
  dgRNA
  Setdb2
ccacacacctaccgc

SEQ ID NO: 81759 - DNA, 15 bp, Artificial Sequence
  dgRNA
  Setdb2
gcgaagtgcctcact

SEQ ID NO: 81760 - DNA, 15 bp, Artificial Sequence
  dgRNA
  Setdb2
tgccgagaacccgat

SEQ ID NO: 81761 - DNA, 15 bp, Artificial Sequence
  dgRNA
  Rcor1
cgccgatgccggcca

SEQ ID NO: 81762 - DNA, 15 bp, Artificial Sequence
  dgRNA
  Rcor1
cgatgccggccatgg

SEQ ID NO: 81763 - DNA, 15 bp, Artificial Sequence
  dgRNA
  Rcor1
ctcagggaagcggcg

SEQ ID NO: 81764 - DNA, 15 bp, Artificial Sequence
  dgRNA
  Rcor1
tcagggaagcggcga

SEQ ID NO: 81765 - DNA, 15 bp, Artificial Sequence
  dgRNA
  N4bp2l2
acttccccccactac

SEQ ID NO: 81766 - DNA, 15 bp, Artificial Sequence
  dgRNA
  N4bp2l2
cccccactacagggc

SEQ ID NO: 81767 - DNA, 15 bp, Artificial Sequence
  dgRNA
  N4bp2l2
ccccactacagggcg

SEQ ID NO: 81768 - DNA, 15 bp, Artificial Sequence
  dgRNA
  N4bp2l2
agactgagtctacgt

SEQ ID NO: 81769 - DNA, 15 bp, Artificial Sequence
  dgRNA
  Tet1
aggtgttgccaagct

SEQ ID NO: 81770 - DNA, 15 bp, Artificial Sequence
  dgRNA
  Tet1
agatgcaaggatgcg

SEQ ID NO: 81771 - DNA, 15 bp, Artificial Sequence
  dgRNA
  Mvb12a
gccccctccgcacac

SEQ ID NO: 81772 - DNA, 15 bp, Artificial Sequence
  dgRNA
  Mvb12a
ccccctccgcacact

SEQ ID NO: 81773 - DNA, 15 bp, Artificial Sequence
  dgRNA
  Mvb12a
actgggtagtgattt

SEQ ID NO: 81774 - DNA, 15 bp, Artificial Sequence
  dgRNA
  Mvb12a
tgggtagtgatttag

SEQ ID NO: 81775 - DNA, 15 bp, Artificial Sequence
  dgRNA
  Cpb2
cacgtacaattagtt

SEQ ID NO: 81776 - DNA, 15 bp, Artificial Sequence
  dgRNA
  Cpb2
ttaaagtgtaacagt

SEQ ID NO: 81777 - DNA, 15 bp, Artificial Sequence
  dgRNA
  Cpb2
gttaaagtgtaacag

SEQ ID NO: 81778 - DNA, 15 bp, Artificial Sequence
  dgRNA
  Tradd
cctgctcagcggact

SEQ ID NO: 81779 - DNA, 15 bp, Artificial Sequence
  dgRNA
  Tradd
gctcagcggactagg

SEQ ID NO: 81780 - DNA, 15 bp, Artificial Sequence
  dgRNA
  Tradd
ctcagcggactaggt

SEQ ID NO: 81781 - DNA, 15 bp, Artificial Sequence
  dgRNA
  Tradd
taggtgggctttacc

SEQ ID NO: 81782 - DNA, 15 bp, Artificial Sequence
  dgRNA
  Pik3cg
gagacgaggtgcccc

SEQ ID NO: 81783 - DNA, 15 bp, Artificial Sequence
  dgRNA
  Pik3cg
cgaggtgccccgggt

SEQ ID NO: 81784 - DNA, 15 bp, Artificial Sequence
  dgRNA
  Pik3cg
ctccgcatcacctcc

SEQ ID NO: 81785 - DNA, 15 bp, Artificial Sequence
  dgRNA
  Pik3cg
tccgcatcacctcca

SEQ ID NO: 81786 - DNA, 15 bp, Artificial Sequence
  dgRNA
  Dexi
ggagcacctcccatg

SEQ ID NO: 81787 - DNA, 15 bp, Artificial Sequence
  dgRNA
  Dexi
atgagtacccgcccc

SEQ ID NO: 81788 - DNA, 15 bp, Artificial Sequence
  dgRNA
  Dexi
tcaagccaataaacg

SEQ ID NO: 81789 - DNA, 15 bp, Artificial Sequence
  dgRNA
  Dexi
gctagccaataaata

SEQ ID NO: 81790 - DNA, 15 bp, Artificial Sequence
  dgRNA
  Slc25a40
cctccgcgccggaac

SEQ ID NO: 81791 - DNA, 15 bp, Artificial Sequence
  dgRNA
  Hist1h3i
tactcggtttaaacg

SEQ ID NO: 81792 - DNA, 15 bp, Artificial Sequence
  dgRNA
  Hist1h3i
gaccaatcccctgtc

SEQ ID NO: 81793 - DNA, 15 bp, Artificial Sequence
  dgRNA
  Hist1h3i
actgtccaatccaaa

SEQ ID NO: 81794 - DNA, 15 bp, Artificial Sequence
  dgRNA
  Hist1h3i
cgtttaaaccgagta

SEQ ID NO: 81795 - DNA, 15 bp, Artificial Sequence
  dgRNA
  Vmn1r170
atttttccccacgaa

SEQ ID NO: 81796 - DNA, 15 bp, Artificial Sequence
  dgRNA
  Vmn1r170
catttttccccacga

SEQ ID NO: 81797 - DNA, 15 bp, Artificial Sequence
  dgRNA
  Adcy7
cacccccgcagtaac

SEQ ID NO: 81798 - DNA, 15 bp, Artificial Sequence
  dgRNA
  Adcy7
ccgcagtaacaggct

SEQ ID NO: 81799 - DNA, 15 bp, Artificial Sequence
  dgRNA
  Adcy7
cgcagtaacaggcta

SEQ ID NO: 81800 - DNA, 15 bp, Artificial Sequence
  dgRNA
  Adcy7
ggatgtgctatgagg

SEQ ID NO: 81801 - DNA, 15 bp, Artificial Sequence
  dgRNA
  Arhgap11a
cgctcgctgtgcttt

SEQ ID NO: 81802 - DNA, 15 bp, Artificial Sequence
  dgRNA
  Arhgap11a
tgctttcggctttgc

SEQ ID NO: 81803 - DNA, 15 bp, Artificial Sequence
  dgRNA
  Arhgap11a
cggaaccttttagac

SEQ ID NO: 81804 - DNA, 15 bp, Artificial Sequence
  dgRNA
  Arhgap11a
cctggccaccccaaa

SEQ ID NO: 81805 - DNA, 15 bp, Artificial Sequence
  dgRNA
  Ndufaf1
cgctggggaattttg

SEQ ID NO: 81806 - DNA, 15 bp, Artificial Sequence
  dgRNA
  Ndufaf1
gttgtcttacgcttt

SEQ ID NO: 81807 - DNA, 15 bp, Artificial Sequence
  dgRNA
  Ndufaf1
agtttgatgtcggac

SEQ ID NO: 81808 - DNA, 15 bp, Artificial Sequence
  dgRNA
  Ndufaf1
tagcgggaccacaac

SEQ ID NO: 81809 - DNA, 15 bp, Artificial Sequence
  dgRNA
  Aldh4a1
gcacgcgctctgtgc

SEQ ID NO: 81810 - DNA, 15 bp, Artificial Sequence
  dgRNA
  Aldh4a1
tgcaggatctgtcat

SEQ ID NO: 81811 - DNA, 15 bp, Artificial Sequence
  dgRNA
  Aldh4a1
gcctgtcctgctgat

SEQ ID NO: 81812 - DNA, 15 bp, Artificial Sequence
  dgRNA
  Aldh4a1
atgcgagactctgat

SEQ ID NO: 81813 - DNA, 15 bp, Artificial Sequence
  dgRNA
  Ap1g1
caacgaggaccactt

SEQ ID NO: 81814 - DNA, 15 bp, Artificial Sequence
  dgRNA
  Ap1g1
cctttcggacaaaac

SEQ ID NO: 81815 - DNA, 15 bp, Artificial Sequence
  dgRNA
  Ap1g1
ggaaccaaagtgcga

SEQ ID NO: 81816 - DNA, 15 bp, Artificial Sequence
  dgRNA
  Ap1g1
aagtgcgacggctcc

SEQ ID NO: 81817 - DNA, 15 bp, Artificial Sequence
  dgRNA
  Fam170b
ttgaaagcatgcgtc

SEQ ID NO: 81818 - DNA, 15 bp, Artificial Sequence
  dgRNA
  Fam170b
tgaaagcatgcgtct

SEQ ID NO: 81819 - DNA, 15 bp, Artificial Sequence
  dgRNA
  Fam170b
actttcctggtaacc

SEQ ID NO: 81820 - DNA, 15 bp, Artificial Sequence
  dgRNA
  Fam170b
cgtttagtcttgcca

SEQ ID NO: 81821 - DNA, 15 bp, Artificial Sequence
  dgRNA
  Ifit1bl1
tgtggtaggttggtc

SEQ ID NO: 81822 - DNA, 15 bp, Artificial Sequence
  dgRNA
  Ifit1bl1
gcaaggtatttatat

SEQ ID NO: 81823 - DNA, 15 bp, Artificial Sequence
  dgRNA
  Spag8
ttgtgcgcagtctcc

SEQ ID NO: 81824 - DNA, 15 bp, Artificial Sequence
  dgRNA
  Spag8
tgtttgccgtctcta

SEQ ID NO: 81825 - DNA, 15 bp, Artificial Sequence
  dgRNA
  Spag8
gagactgcgcacaac

SEQ ID NO: 81826 - DNA, 15 bp, Artificial Sequence
  dgRNA
  Spag8
acggcaaacaactcc

SEQ ID NO: 81827 - DNA, 15 bp, Artificial Sequence
  dgRNA
  Znrd1
attcccttccgccag

SEQ ID NO: 81828 - DNA, 15 bp, Artificial Sequence
  dgRNA
  Znrd1
cttccgccagaggtt

SEQ ID NO: 81829 - DNA, 15 bp, Artificial Sequence
  dgRNA
  Znrd1
gacgtcacgacccaa

SEQ ID NO: 81830 - DNA, 15 bp, Artificial Sequence
  dgRNA
  Znrd1
gacccaacggccacc

SEQ ID NO: 81831 - DNA, 15 bp, Artificial Sequence
  dgRNA
  Kif3b
ggcacccgagaccag

SEQ ID NO: 81832 - DNA, 15 bp, Artificial Sequence
  dgRNA
  Kif3b
cgagtccgggtgcct

SEQ ID NO: 81833 - DNA, 15 bp, Artificial Sequence
  dgRNA
  Kif3b
gtccgggtgcctagg

SEQ ID NO: 81834 - DNA, 15 bp, Artificial Sequence
  dgRNA
  Kif3b
tccgggtgcctagga

SEQ ID NO: 81835 - DNA, 15 bp, Artificial Sequence
  dgRNA
  Cldn7
tcggagggcaccgaa

SEQ ID NO: 81836 - DNA, 15 bp, Artificial Sequence
  dgRNA
  Cldn7
cggagggcaccgaaa

SEQ ID NO: 81837 - DNA, 15 bp, Artificial Sequence
  dgRNA
  Cldn7
gagttttccgagggt

SEQ ID NO: 81838 - DNA, 15 bp, Artificial Sequence
  dgRNA
  Atl3
gcttttagtaagcct

SEQ ID NO: 81839 - DNA, 15 bp, Artificial Sequence
  dgRNA
  Atl3
ataatgaagtcacga

SEQ ID NO: 81840 - DNA, 15 bp, Artificial Sequence
  dgRNA
  Atl3
aagtaacgccggtcg

SEQ ID NO: 81841 - DNA, 15 bp, Artificial Sequence
  dgRNA
  Atl3
aagctaaagtaacgc

SEQ ID NO: 81842 - DNA, 15 bp, Artificial Sequence
  dgRNA
  Tll1
caaacgaagtcagag

SEQ ID NO: 81843 - DNA, 15 bp, Artificial Sequence
  dgRNA
  Tll1
acgaagtcagagagg

SEQ ID NO: 81844 - DNA, 15 bp, Artificial Sequence
  dgRNA
  Tll1
caggatgcgagtgat

SEQ ID NO: 81845 - DNA, 15 bp, Artificial Sequence
  dgRNA
  Tll1
aggatgcgagtgatt

SEQ ID NO: 81846 - DNA, 15 bp, Artificial Sequence
  dgRNA
  Wnt1
tgtctccgcgccccc

SEQ ID NO: 81847 - DNA, 15 bp, Artificial Sequence
  dgRNA
  Wnt1
ccccctggcggatgc

SEQ ID NO: 81848 - DNA, 15 bp, Artificial Sequence
  dgRNA
  Wnt1
gatgctggtccccga

SEQ ID NO: 81849 - DNA, 15 bp, Artificial Sequence
  dgRNA
  Wnt1
atgctggtccccgac

SEQ ID NO: 81850 - DNA, 15 bp, Artificial Sequence
  dgRNA
  Rit1
ccggcgccatcttcc

SEQ ID NO: 81851 - DNA, 15 bp, Artificial Sequence
  dgRNA
  Rit1
ttccaggacccgggc

SEQ ID NO: 81852 - DNA, 15 bp, Artificial Sequence
  dgRNA
  Rit1
acccgggcggggccc

SEQ ID NO: 81853 - DNA, 15 bp, Artificial Sequence
  dgRNA
  Rit1
tggcgccggtgggcg

SEQ ID NO: 81854 - DNA, 15 bp, Artificial Sequence
  dgRNA
  4930503L19Rik
acctccccctcccgg

SEQ ID NO: 81855 - DNA, 15 bp, Artificial Sequence
  dgRNA
  4930503L19Rik
ctctgaactcttcgc

SEQ ID NO: 81856 - DNA, 15 bp, Artificial Sequence
  dgRNA
  4930503L19Rik
tctgaactcttcgcc

SEQ ID NO: 81857 - DNA, 15 bp, Artificial Sequence
  dgRNA
  4930503L19Rik
atccctcccggcgcc

SEQ ID NO: 81858 - DNA, 15 bp, Artificial Sequence
  dgRNA
  Tat
ggacaaatcccagat

SEQ ID NO: 81859 - DNA, 15 bp, Artificial Sequence
  dgRNA
  Tat
attggatggtggccc

SEQ ID NO: 81860 - DNA, 15 bp, Artificial Sequence
  dgRNA
  Tat
tcaaccaatagcata

SEQ ID NO: 81861 - DNA, 15 bp, Artificial Sequence
  dgRNA
  Tat
caaccaatagcataa

SEQ ID NO: 81862 - DNA, 15 bp, Artificial Sequence
  dgRNA
  AI464131
tagaggcgggcccaa

SEQ ID NO: 81863 - DNA, 15 bp, Artificial Sequence
  dgRNA
  AI464131
agaggcgggcccaaa

SEQ ID NO: 81864 - DNA, 15 bp, Artificial Sequence
  dgRNA
  AI464131
gcaaggcacgcagag

SEQ ID NO: 81865 - DNA, 15 bp, Artificial Sequence
  dgRNA
  AI464131
caaggcacgcagagt

SEQ ID NO: 81866 - DNA, 15 bp, Artificial Sequence
  dgRNA
  Catsper2
ctgcgctcgcgcgtc

SEQ ID NO: 81867 - DNA, 15 bp, Artificial Sequence
  dgRNA
  Catsper2
ctcgcgcgtctggcc

SEQ ID NO: 81868 - DNA, 15 bp, Artificial Sequence
  dgRNA
  Catsper2
tcgcgcgtctggccc

SEQ ID NO: 81869 - DNA, 15 bp, Artificial Sequence
  dgRNA
  Catsper2
ccccctaggcctgct

SEQ ID NO: 81870 - DNA, 15 bp, Artificial Sequence
  dgRNA
  Stx1a
gatcactagttgacg

SEQ ID NO: 81871 - DNA, 15 bp, Artificial Sequence
  dgRNA
  Stx1a
atcactagttgacga

SEQ ID NO: 81872 - DNA, 15 bp, Artificial Sequence
  dgRNA
  Stx1a
tcactagttgacgag

SEQ ID NO: 81873 - DNA, 15 bp, Artificial Sequence
  dgRNA
  Stx1a
acgaggggaggaacc

SEQ ID NO: 81874 - DNA, 15 bp, Artificial Sequence
  dgRNA
  Isyna1
gtggccatcgctcat

SEQ ID NO: 81875 - DNA, 15 bp, Artificial Sequence
  dgRNA
  Isyna1
cgctcattggctgcc

SEQ ID NO: 81876 - DNA, 15 bp, Artificial Sequence
  dgRNA
  Isyna1
caagggtgcgcagcg

SEQ ID NO: 81877 - DNA, 15 bp, Artificial Sequence
  dgRNA
  Isyna1
ctccttccggctacc

SEQ ID NO: 81878 - DNA, 15 bp, Artificial Sequence
  dgRNA
  Nkx3-2
tcaacggcctccagt

SEQ ID NO: 81879 - DNA, 15 bp, Artificial Sequence
  dgRNA
  Nkx3-2
cagccaatccactgc

SEQ ID NO: 81880 - DNA, 15 bp, Artificial Sequence
  dgRNA
  Nkx3-2
ctgccgggagagccc

SEQ ID NO: 81881 - DNA, 15 bp, Artificial Sequence
  dgRNA
  Nkx3-2
gctagtgaaggggcg

SEQ ID NO: 81882 - DNA, 15 bp, Artificial Sequence
  dgRNA
  1810022K09Rik
cctcctccccttcga

SEQ ID NO: 81883 - DNA, 15 bp, Artificial Sequence
  dgRNA
  1810022K09Rik
cctccccttcgaagg

SEQ ID NO: 81884 - DNA, 15 bp, Artificial Sequence
  dgRNA
  1810022K09Rik
gcggctccttccgag

SEQ ID NO: 81885 - DNA, 15 bp, Artificial Sequence
  dgRNA
  1810022K09Rik
cggctccttccgagt

SEQ ID NO: 81886 - DNA, 15 bp, Artificial Sequence
  dgRNA
  Cidea
cccccgggaactcgc

SEQ ID NO: 81887 - DNA, 15 bp, Artificial Sequence
  dgRNA
  Cidea
ccctgggtcgggctt

SEQ ID NO: 81888 - DNA, 15 bp, Artificial Sequence
  dgRNA
  Cidea
acttcgggttctcag

SEQ ID NO: 81889 - DNA, 15 bp, Artificial Sequence
  dgRNA
  Cidea
taaccgcagcacttc

SEQ ID NO: 81890 - DNA, 15 bp, Artificial Sequence
  dgRNA
  Prss43
tgatgttatgttgtc

SEQ ID NO: 81891 - DNA, 15 bp, Artificial Sequence
  dgRNA
  Prss43
tatgttgtctgggac

SEQ ID NO: 81892 - DNA, 15 bp, Artificial Sequence
  dgRNA
  Tbx22
aggttgtgaccgact

SEQ ID NO: 81893 - DNA, 15 bp, Artificial Sequence
  dgRNA
  Tbx22
gggcattcactcagt

SEQ ID NO: 81894 - DNA, 15 bp, Artificial Sequence
  dgRNA
  Tbx22
caacctccactgttt

SEQ ID NO: 81895 - DNA, 15 bp, Artificial Sequence
  dgRNA
  Tbx22
atctgccaccaaagg

SEQ ID NO: 81896 - DNA, 15 bp, Artificial Sequence
  dgRNA
  Ube2d2b
aactgcagtcgtcag

SEQ ID NO: 81897 - DNA, 15 bp, Artificial Sequence
  dgRNA
  Ube2d2b
gccaaagctaagatt

SEQ ID NO: 81898 - DNA, 15 bp, Artificial Sequence
  dgRNA
  Ube2d2b
atgagttcgtgatga

SEQ ID NO: 81899 - DNA, 15 bp, Artificial Sequence
  dgRNA
  Ube2d2b
cgactgcagttcact

SEQ ID NO: 81900 - DNA, 15 bp, Artificial Sequence
  dgRNA
  Pdia3
cctccagccctttcg

SEQ ID NO: 81901 - DNA, 15 bp, Artificial Sequence
  dgRNA
  Pdia3
ctccagccctttcgc

SEQ ID NO: 81902 - DNA, 15 bp, Artificial Sequence
  dgRNA
  Pdia3
cagcgggtggcgctc

SEQ ID NO: 81903 - DNA, 15 bp, Artificial Sequence
  dgRNA
  Pdia3
agcgggtggcgctca

SEQ ID NO: 81904 - DNA, 15 bp, Artificial Sequence
  dgRNA
  Atad2
tcgcaaattcctgtg

SEQ ID NO: 81905 - DNA, 15 bp, Artificial Sequence
  dgRNA
  Atad2
cgcaaattcctgtga

SEQ ID NO: 81906 - DNA, 15 bp, Artificial Sequence
  dgRNA
  Atad2
tgagggggctcgacg

SEQ ID NO: 81907 - DNA, 15 bp, Artificial Sequence
  dgRNA
  Atad2
ctcgacgcggttcgc

SEQ ID NO: 81908 - DNA, 15 bp, Artificial Sequence
  dgRNA
  Agap1
cgcaccccacgcgcg

SEQ ID NO: 81909 - DNA, 15 bp, Artificial Sequence
  dgRNA
  Agap1
gcaccccacgcgcgc

SEQ ID NO: 81910 - DNA, 15 bp, Artificial Sequence
  dgRNA
  Agap1
cccacgcgcgcgggc

SEQ ID NO: 81911 - DNA, 15 bp, Artificial Sequence
  dgRNA
  Agap1
cggcccgcgcgcgtg

SEQ ID NO: 81912 - DNA, 15 bp, Artificial Sequence
  dgRNA
  1190003K10Rik
gattatacccaagtg

SEQ ID NO: 81913 - DNA, 15 bp, Artificial Sequence
  dgRNA
  1190003K10Rik
cccctttgcacacta

SEQ ID NO: 81914 - DNA, 15 bp, Artificial Sequence
  dgRNA
  1190003K10Rik
ccctttgcacactaa

SEQ ID NO: 81915 - DNA, 15 bp, Artificial Sequence
  dgRNA
  1190003K10Rik
cctttgcacactaag

SEQ ID NO: 81916 - DNA, 15 bp, Artificial Sequence
  dgRNA
  Sorbs2
ccccccatggagtgg

SEQ ID NO: 81917 - DNA, 15 bp, Artificial Sequence
  dgRNA
  Sorbs2
gtggtgaaacgggca

SEQ ID NO: 81918 - DNA, 15 bp, Artificial Sequence
  dgRNA
  Sorbs2
aaaacgcaatgagag

SEQ ID NO: 81919 - DNA, 15 bp, Artificial Sequence
  dgRNA
  Capza2
atagcaatcccactt

SEQ ID NO: 81920 - DNA, 15 bp, Artificial Sequence
  dgRNA
  Capza2
cgcacagcggcgctc

SEQ ID NO: 81921 - DNA, 15 bp, Artificial Sequence
  dgRNA
  Capza2
cagcggcgctcaggc

SEQ ID NO: 81922 - DNA, 15 bp, Artificial Sequence
  dgRNA
  Capza2
ctcaggccggcgctc

SEQ ID NO: 81923 - DNA, 15 bp, Artificial Sequence
  dgRNA
  Emc6
gcctccagcgcaaga

SEQ ID NO: 81924 - DNA, 15 bp, Artificial Sequence
  dgRNA
  Emc6
gggctcggtttgcgc

SEQ ID NO: 81925 - DNA, 15 bp, Artificial Sequence
  dgRNA
  Emc6
gccatcttgcgctgg

SEQ ID NO: 81926 - DNA, 15 bp, Artificial Sequence
  dgRNA
  Thop1
catcctggcgttccg

SEQ ID NO: 81927 - DNA, 15 bp, Artificial Sequence
  dgRNA
  Thop1
atcctggcgttccga

SEQ ID NO: 81928 - DNA, 15 bp, Artificial Sequence
  dgRNA
  Thop1
ttccgagggtgcgta

SEQ ID NO: 81929 - DNA, 15 bp, Artificial Sequence
  dgRNA
  Thop1
tatgacagccaattg

SEQ ID NO: 81930 - DNA, 15 bp, Artificial Sequence
  dgRNA
  Tigd3
aagctcctcctccgg

SEQ ID NO: 81931 - DNA, 15 bp, Artificial Sequence
  dgRNA
  Tigd3
agctcctcctccgga

SEQ ID NO: 81932 - DNA, 15 bp, Artificial Sequence
  dgRNA
  Tigd3
atcagatgtaactgg

SEQ ID NO: 81933 - DNA, 15 bp, Artificial Sequence
  dgRNA
  Tigd3
acaagttgccgctga

SEQ ID NO: 81934 - DNA, 15 bp, Artificial Sequence
  dgRNA
  Bbx
tcgcccactgtctac

SEQ ID NO: 81935 - DNA, 15 bp, Artificial Sequence
  dgRNA
  Bbx
aacgcgcctcctgtt

SEQ ID NO: 81936 - DNA, 15 bp, Artificial Sequence
  dgRNA
  Bbx
gccgcccgtccgtca

SEQ ID NO: 81937 - DNA, 15 bp, Artificial Sequence
  dgRNA
  Bbx
ccgtccgtcacggcg

SEQ ID NO: 81938 - DNA, 15 bp, Artificial Sequence
  dgRNA
  Atf6b
ggaaccctaagtgct

SEQ ID NO: 81939 - DNA, 15 bp, Artificial Sequence
  dgRNA
  Atf6b
acgcacagtctcgcc

SEQ ID NO: 81940 - DNA, 15 bp, Artificial Sequence
  dgRNA
  Atf6b
cagtctcgcctggat

SEQ ID NO: 81941 - DNA, 15 bp, Artificial Sequence
  dgRNA
  Atf6b
cctggatcggtaaag

SEQ ID NO: 81942 - DNA, 15 bp, Artificial Sequence
  dgRNA
  Gxylt2
gacgcattgaagatg

SEQ ID NO: 81943 - DNA, 15 bp, Artificial Sequence
  dgRNA
  Gxylt2
gcgcctgagtgccag

SEQ ID NO: 81944 - DNA, 15 bp, Artificial Sequence
  dgRNA
  Gxylt2
ccacacagtacggta

SEQ ID NO: 81945 - DNA, 15 bp, Artificial Sequence
  dgRNA
  Gxylt2
cacagtacggtaagg

SEQ ID NO: 81946 - DNA, 15 bp, Artificial Sequence
  dgRNA
  Sec24b
tcctcttccgaggat

SEQ ID NO: 81947 - DNA, 15 bp, Artificial Sequence
  dgRNA
  Sec24b
ccgaggatgggtacg

SEQ ID NO: 81948 - DNA, 15 bp, Artificial Sequence
  dgRNA
  Sec24b
cgaggatgggtacgt

SEQ ID NO: 81949 - DNA, 15 bp, Artificial Sequence
  dgRNA
  Sec24b
ggactggcgtgaccc

SEQ ID NO: 81950 - DNA, 15 bp, Artificial Sequence
  dgRNA
  1190007I07Rik
aggcaatactcgcgc

SEQ ID NO: 81951 - DNA, 15 bp, Artificial Sequence
  dgRNA
  Ceacam10
gaggcccgcactgac

SEQ ID NO: 81952 - DNA, 15 bp, Artificial Sequence
  dgRNA
  Ceacam10
cagcccacgtgaatc

SEQ ID NO: 81953 - DNA, 15 bp, Artificial Sequence
  dgRNA
  Ceacam10
agcccacgtgaatct

SEQ ID NO: 81954 - DNA, 15 bp, Artificial Sequence
  dgRNA
  Ceacam10
attcacgtgggctgg

SEQ ID NO: 81955 - DNA, 15 bp, Artificial Sequence
  dgRNA
  Trafd1
cccacggctggccaa

SEQ ID NO: 81956 - DNA, 15 bp, Artificial Sequence
  dgRNA
  Trafd1
ccacggctggccaat

SEQ ID NO: 81957 - DNA, 15 bp, Artificial Sequence
  dgRNA
  Trafd1
gctggccaatgggcg

SEQ ID NO: 81958 - DNA, 15 bp, Artificial Sequence
  dgRNA
  Trafd1
cgtggccctcggcga

SEQ ID NO: 81959 - DNA, 15 bp, Artificial Sequence
  dgRNA
  Sipa1l2
aaatcgcctgtagac

SEQ ID NO: 81960 - DNA, 15 bp, Artificial Sequence
  dgRNA
  Sipa1l2
gagtgctgccgaagc

SEQ ID NO: 81961 - DNA, 15 bp, Artificial Sequence
  dgRNA
  Sipa1l2
ggagcacactcgtcg

SEQ ID NO: 81962 - DNA, 15 bp, Artificial Sequence
  dgRNA
  Sipa1l2
tcagtaccggtctac

SEQ ID NO: 81963 - DNA, 15 bp, Artificial Sequence
  dgRNA
  Pcf11
accgcgtctccgagc

SEQ ID NO: 81964 - DNA, 15 bp, Artificial Sequence
  dgRNA
  Pcf11
gcgtctccgagccgg

SEQ ID NO: 81965 - DNA, 15 bp, Artificial Sequence
  dgRNA
  Pcf11
gccgagactcgaccg

SEQ ID NO: 81966 - DNA, 15 bp, Artificial Sequence
  dgRNA
  Pcf11
ctcgaccgaggaaga

SEQ ID NO: 81967 - DNA, 15 bp, Artificial Sequence
  dgRNA
  Hist1h2ak
atgcaactctgttat

SEQ ID NO: 81968 - DNA, 15 bp, Artificial Sequence
  dgRNA
  Hist1h2ak
aaccacttactgagc

SEQ ID NO: 81969 - DNA, 15 bp, Artificial Sequence
  dgRNA
  Hist1h2ak
gcaggcttatattct

SEQ ID NO: 81970 - DNA, 15 bp, Artificial Sequence
  dgRNA
  Hist1h2ak
ctatgattgggtatt

SEQ ID NO: 81971 - DNA, 15 bp, Artificial Sequence
  dgRNA
  Mcm3ap
atccgaccgtgaaga

SEQ ID NO: 81972 - DNA, 15 bp, Artificial Sequence
  dgRNA
  Mcm3ap
gaccgtgaagaaggt

SEQ ID NO: 81973 - DNA, 15 bp, Artificial Sequence
  dgRNA
  Mcm3ap
accgtgaagaaggtc

SEQ ID NO: 81974 - DNA, 15 bp, Artificial Sequence
  dgRNA
  Mcm3ap
ccgtgaagaaggtcg

SEQ ID NO: 81975 - DNA, 15 bp, Artificial Sequence
  dgRNA
  Ppl
tagtcgtccaggttc

SEQ ID NO: 81976 - DNA, 15 bp, Artificial Sequence
  dgRNA
  Ppl
ccaggttctggcgac

SEQ ID NO: 81977 - DNA, 15 bp, Artificial Sequence
  dgRNA
  Ppl
gcagtaacaggcaac

SEQ ID NO: 81978 - DNA, 15 bp, Artificial Sequence
  dgRNA
  Ppl
aacaggggcggtgtc

SEQ ID NO: 81979 - DNA, 15 bp, Artificial Sequence
  dgRNA
  Pex11b
cgggccgctgcgccg

SEQ ID NO: 81980 - DNA, 15 bp, Artificial Sequence
  dgRNA
  Pex11b
gggccgctgcgccgt

SEQ ID NO: 81981 - DNA, 15 bp, Artificial Sequence
  dgRNA
  Pex11b
gctgcgccgtgggcc

SEQ ID NO: 81982 - DNA, 15 bp, Artificial Sequence
  dgRNA
  Pex11b
ctgcgccgtgggccc

SEQ ID NO: 81983 - DNA, 15 bp, Artificial Sequence
  dgRNA
  Olfr1166
ttatgggttcttatg

SEQ ID NO: 81984 - DNA, 15 bp, Artificial Sequence
  dgRNA
  Olfr1166
gaatcatgtgaatca

SEQ ID NO: 81985 - DNA, 15 bp, Artificial Sequence
  dgRNA
  Stx6
cagagccccgcctct

SEQ ID NO: 81986 - DNA, 15 bp, Artificial Sequence
  dgRNA
  Stx6
ctagtgacgcaagct

SEQ ID NO: 81987 - DNA, 15 bp, Artificial Sequence
  dgRNA
  Stx6
gcccctctccggcgc

SEQ ID NO: 81988 - DNA, 15 bp, Artificial Sequence
  dgRNA
  Stx6
cccctctccggcgca

SEQ ID NO: 81989 - DNA, 15 bp, Artificial Sequence
  dgRNA
  Olfr64
aacatttgcgtgcag

SEQ ID NO: 81990 - DNA, 15 bp, Artificial Sequence
  dgRNA
  Olfr64
acatttgcgtgcaga

SEQ ID NO: 81991 - DNA, 15 bp, Artificial Sequence
  dgRNA
  Olfr64
ttgcgtgcagaggga

SEQ ID NO: 81992 - DNA, 15 bp, Artificial Sequence
  dgRNA
  Rab15
cgcctctcagatcgt

SEQ ID NO: 81993 - DNA, 15 bp, Artificial Sequence
  dgRNA
  Rab15
ctctcagatcgtcgg

SEQ ID NO: 81994 - DNA, 15 bp, Artificial Sequence
  dgRNA
  Rab15
cttccgaaccctgcc

SEQ ID NO: 81995 - DNA, 15 bp, Artificial Sequence
  dgRNA
  Rab15
ttccgaaccctgccc

SEQ ID NO: 81996 - DNA, 15 bp, Artificial Sequence
  dgRNA
  Tbrg1
gacgtgcattccctg

SEQ ID NO: 81997 - DNA, 15 bp, Artificial Sequence
  dgRNA
  Tbrg1
acgtgcattccctga

SEQ ID NO: 81998 - DNA, 15 bp, Artificial Sequence
  dgRNA
  Tbrg1
ctgagcgtctgcatc

SEQ ID NO: 81999 - DNA, 15 bp, Artificial Sequence
  dgRNA
  Tbrg1
tcttccctacttcgc

SEQ ID NO: 82000 - DNA, 15 bp, Artificial Sequence
  dgRNA
  Snhg11
gactgatcggaagaa

SEQ ID NO: 82001 - DNA, 15 bp, Artificial Sequence
  dgRNA
  Snhg11
gaaggagagcctcga

SEQ ID NO: 82002 - DNA, 15 bp, Artificial Sequence
  dgRNA
  Snhg11
gcgcagtaagcattt

SEQ ID NO: 82003 - DNA, 15 bp, Artificial Sequence
  dgRNA
  Snhg11
cggttctactcctgc

SEQ ID NO: 82004 - DNA, 15 bp, Artificial Sequence
  dgRNA
  Zfp654
ttttagactacttga

SEQ ID NO: 82005 - DNA, 15 bp, Artificial Sequence
  dgRNA
  Ubd
cagatagattggcta

SEQ ID NO: 82006 - DNA, 15 bp, Artificial Sequence
  dgRNA
  Ubd
gatagattggctaag

SEQ ID NO: 82007 - DNA, 15 bp, Artificial Sequence
  dgRNA
  Ubd
aggttgctgctaaac

SEQ ID NO: 82008 - DNA, 15 bp, Artificial Sequence
  dgRNA
  Bcor
tcacggtagacaagg

SEQ ID NO: 82009 - DNA, 15 bp, Artificial Sequence
  dgRNA
  Bcor
aggcggagtgtgcag

SEQ ID NO: 82010 - DNA, 15 bp, Artificial Sequence
  dgRNA
  Bcor
ggcggagtgtgcaga

SEQ ID NO: 82011 - DNA, 15 bp, Artificial Sequence
  dgRNA
  Bcor
ggggtcctttgcgcg

SEQ ID NO: 82012 - DNA, 15 bp, Artificial Sequence
  dgRNA
  BC004004
tgagccaagtgtaaa

SEQ ID NO: 82013 - DNA, 15 bp, Artificial Sequence
  dgRNA
  BC004004
gagccaagtgtaaat

SEQ ID NO: 82014 - DNA, 15 bp, Artificial Sequence
  dgRNA
  BC004004
ttgagtcaatgagtc

SEQ ID NO: 82015 - DNA, 15 bp, Artificial Sequence
  dgRNA
  BC004004
cttctacgactgaga

SEQ ID NO: 82016 - DNA, 15 bp, Artificial Sequence
  dgRNA
  Grin2a
atgggtcgaagaatg

SEQ ID NO: 82017 - DNA, 15 bp, Artificial Sequence
  dgRNA
  Grin2a
gtcgaagaatgtgga

SEQ ID NO: 82018 - DNA, 15 bp, Artificial Sequence
  dgRNA
  Grin2a
attcgactctcagag

SEQ ID NO: 82019 - DNA, 15 bp, Artificial Sequence
  dgRNA
  Grin2a
ttcgactctcagagc

SEQ ID NO: 82020 - DNA, 15 bp, Artificial Sequence
  dgRNA
  Mcm7
agggccttagaactg

SEQ ID NO: 82021 - DNA, 15 bp, Artificial Sequence
  dgRNA
  Mcm7
tcatggtaactactg

SEQ ID NO: 82022 - DNA, 15 bp, Artificial Sequence
  dgRNA
  Them5
gctaaaagcacctat

SEQ ID NO: 82023 - DNA, 15 bp, Artificial Sequence
  dgRNA
  Them5
ctgcttgaatgtgaa

SEQ ID NO: 82024 - DNA, 15 bp, Artificial Sequence
  dgRNA
  Them5
ataggtgcttttagc

SEQ ID NO: 82025 - DNA, 15 bp, Artificial Sequence
  dgRNA
  Them5
tgttacaacacccat

SEQ ID NO: 82026 - DNA, 15 bp, Artificial Sequence
  dgRNA
  Srxn1
ccgactcatcctctc

SEQ ID NO: 82027 - DNA, 15 bp, Artificial Sequence
  dgRNA
  Srxn1
cgactcatcctctct

SEQ ID NO: 82028 - DNA, 15 bp, Artificial Sequence
  dgRNA
  Srxn1
cccgcgtcctcgcct

SEQ ID NO: 82029 - DNA, 15 bp, Artificial Sequence
  dgRNA
  Srxn1
gcgtcctcgcctcgg

SEQ ID NO: 82030 - DNA, 15 bp, Artificial Sequence
  dgRNA
  Gadd45b
gccctgacccccacg

SEQ ID NO: 82031 - DNA, 15 bp, Artificial Sequence
  dgRNA
  Gadd45b
cctgacccccacgtg

SEQ ID NO: 82032 - DNA, 15 bp, Artificial Sequence
  dgRNA
  Gadd45b
cccacgtggggccgc

SEQ ID NO: 82033 - DNA, 15 bp, Artificial Sequence
  dgRNA
  Gadd45b
cagccaatctcagcg

SEQ ID NO: 82034 - DNA, 15 bp, Artificial Sequence
  dgRNA
  Fcf1
acgggggctgcaacg

SEQ ID NO: 82035 - DNA, 15 bp, Artificial Sequence
  dgRNA
  Fcf1
gccaagtcctagttc

SEQ ID NO: 82036 - DNA, 15 bp, Artificial Sequence
  dgRNA
  Fcf1
tagttctggggtccg

SEQ ID NO: 82037 - DNA, 15 bp, Artificial Sequence
  dgRNA
  Fcf1
ggtccgaggaagcag

SEQ ID NO: 82038 - DNA, 15 bp, Artificial Sequence
  dgRNA
  Bbs5
accaaatgacgcaaa

SEQ ID NO: 82039 - DNA, 15 bp, Artificial Sequence
  dgRNA
  Bbs5
ccaaatgacgcaaac

SEQ ID NO: 82040 - DNA, 15 bp, Artificial Sequence
  dgRNA
  Bbs5
atgacgcaaacgggc

SEQ ID NO: 82041 - DNA, 15 bp, Artificial Sequence
  dgRNA
  Bbs5
tgacgcaaacgggct

SEQ ID NO: 82042 - DNA, 15 bp, Artificial Sequence
  dgRNA
  Ccdc47
gtgacgtctacccga

SEQ ID NO: 82043 - DNA, 15 bp, Artificial Sequence
  dgRNA
  Ccdc47
cgtctacccgacgga

SEQ ID NO: 82044 - DNA, 15 bp, Artificial Sequence
  dgRNA
  Ccdc47
acggacggaacccta

SEQ ID NO: 82045 - DNA, 15 bp, Artificial Sequence
  dgRNA
  Ccdc47
cggacggaaccctac

SEQ ID NO: 82046 - DNA, 15 bp, Artificial Sequence
  dgRNA
  Sirt5
ggtacaaacatttgc

SEQ ID NO: 82047 - DNA, 15 bp, Artificial Sequence
  dgRNA
  Lonrf2
ctacatatgagcacc

SEQ ID NO: 82048 - DNA, 15 bp, Artificial Sequence
  dgRNA
  Lonrf2
catatgagcaccggg

SEQ ID NO: 82049 - DNA, 15 bp, Artificial Sequence
  dgRNA
  Lonrf2
gttcactcgttaaat

SEQ ID NO: 82050 - DNA, 15 bp, Artificial Sequence
  dgRNA
  Lonrf2
agttcactcgttaaa

SEQ ID NO: 82051 - DNA, 15 bp, Artificial Sequence
  dgRNA
  Il1rapl1
atctcgtgctgttcg

SEQ ID NO: 82052 - DNA, 15 bp, Artificial Sequence
  dgRNA
  Il1rapl1
ttgtcgttttcgctc

SEQ ID NO: 82053 - DNA, 15 bp, Artificial Sequence
  dgRNA
  Tmem173
tgaactgagcgaaac

SEQ ID NO: 82054 - DNA, 15 bp, Artificial Sequence
  dgRNA
  Tmem173
gggaaattagaggcg

SEQ ID NO: 82055 - DNA, 15 bp, Artificial Sequence
  dgRNA
  Tmem173
ggtccagatagccaa

SEQ ID NO: 82056 - DNA, 15 bp, Artificial Sequence
  dgRNA
  Tmem173
agagcactcttttcg

SEQ ID NO: 82057 - DNA, 15 bp, Artificial Sequence
  dgRNA
  Wsb1
tcccgggcttgccct

SEQ ID NO: 82058 - DNA, 15 bp, Artificial Sequence
  dgRNA
  Wsb1
ttcgaaaatgcccgc

SEQ ID NO: 82059 - DNA, 15 bp, Artificial Sequence
  dgRNA
  Wsb1
gcaggtcgcgctttg

SEQ ID NO: 82060 - DNA, 15 bp, Artificial Sequence
  dgRNA
  Wsb1
caggtcgcgctttga

SEQ ID NO: 82061 - DNA, 15 bp, Artificial Sequence
  dgRNA
  Kera
ctggaattgttggat

SEQ ID NO: 82062 - DNA, 15 bp, Artificial Sequence
  dgRNA
  Kera
gggtcaattcattac

SEQ ID NO: 82063 - DNA, 15 bp, Artificial Sequence
  dgRNA
  Kera
ggtcaattcattact

SEQ ID NO: 82064 - DNA, 15 bp, Artificial Sequence
  dgRNA
  Wdr45b
tccgcagcttcccct

SEQ ID NO: 82065 - DNA, 15 bp, Artificial Sequence
  dgRNA
  Wdr45b
ccttatggacgcgcc

SEQ ID NO: 82066 - DNA, 15 bp, Artificial Sequence
  dgRNA
  Wdr45b
gacgcgtctgtccct

SEQ ID NO: 82067 - DNA, 15 bp, Artificial Sequence
  dgRNA
  Wdr45b
tccctcggcgcttgc

SEQ ID NO: 82068 - DNA, 15 bp, Artificial Sequence
  dgRNA
  Mknk2
ctccgccccttaaac

SEQ ID NO: 82069 - DNA, 15 bp, Artificial Sequence
  dgRNA
  Mknk2
gtgctcttctcgctg

SEQ ID NO: 82070 - DNA, 15 bp, Artificial Sequence
  dgRNA
  Mknk2
ggccttcgacgctcc

SEQ ID NO: 82071 - DNA, 15 bp, Artificial Sequence
  dgRNA
  Mknk2
aggcggagactggtg

SEQ ID NO: 82072 - DNA, 15 bp, Artificial Sequence
  dgRNA
  Ttc14
tatcaccctagtagt

SEQ ID NO: 82073 - DNA, 15 bp, Artificial Sequence
  dgRNA
  Ttc14
cgctttaaagctctc

SEQ ID NO: 82074 - DNA, 15 bp, Artificial Sequence
  dgRNA
  Ttc14
gctttaaagctctcc

SEQ ID NO: 82075 - DNA, 15 bp, Artificial Sequence
  dgRNA
  Ttc14
taaagctctccgggc

SEQ ID NO: 82076 - DNA, 15 bp, Artificial Sequence
  dgRNA
  Spata9
aagagtagacgagtg

SEQ ID NO: 82077 - DNA, 15 bp, Artificial Sequence
  dgRNA
  Spata9
aactgtattggtggg

SEQ ID NO: 82078 - DNA, 15 bp, Artificial Sequence
  dgRNA
  Myg1
agccccctagccaca

SEQ ID NO: 82079 - DNA, 15 bp, Artificial Sequence
  dgRNA
  Myg1
cacacggccttatag

SEQ ID NO: 82080 - DNA, 15 bp, Artificial Sequence
  dgRNA
  Myg1
ttccaaccagaggtt

SEQ ID NO: 82081 - DNA, 15 bp, Artificial Sequence
  dgRNA
  Myg1
tccaaccagaggttt

SEQ ID NO: 82082 - DNA, 15 bp, Artificial Sequence
  dgRNA
  Daw1
caagctatggctgag

SEQ ID NO: 82083 - DNA, 15 bp, Artificial Sequence
  dgRNA
  Daw1
gagtttacccagctc

SEQ ID NO: 82084 - DNA, 15 bp, Artificial Sequence
  dgRNA
  Daw1
tctgggcgggtacag

SEQ ID NO: 82085 - DNA, 15 bp, Artificial Sequence
  dgRNA
  Daw1
ttctgggcgggtaca

SEQ ID NO: 82086 - DNA, 15 bp, Artificial Sequence
  dgRNA
  Ptchd4
ccctcgcatgctttg

SEQ ID NO: 82087 - DNA, 15 bp, Artificial Sequence
  dgRNA
  Ptchd4
cagaattcgagggca

SEQ ID NO: 82088 - DNA, 15 bp, Artificial Sequence
  dgRNA
  Ptchd4
agaattcgagggcac

SEQ ID NO: 82089 - DNA, 15 bp, Artificial Sequence
  dgRNA
  Ptchd4
gaattcgagggcacg

SEQ ID NO: 82090 - DNA, 15 bp, Artificial Sequence
  dgRNA
  Gm13084
gttcttgactctgtc

SEQ ID NO: 82091 - DNA, 15 bp, Artificial Sequence
  dgRNA
  Mycn
ggcttttggcgcgaa

SEQ ID NO: 82092 - DNA, 15 bp, Artificial Sequence
  dgRNA
  Mycn
tggcgcgaaaggctt

SEQ ID NO: 82093 - DNA, 15 bp, Artificial Sequence
  dgRNA
  Mycn
ctcccctgattttta

SEQ ID NO: 82094 - DNA, 15 bp, Artificial Sequence
  dgRNA
  Mycn
cgcagacgaggggga

SEQ ID NO: 82095 - DNA, 15 bp, Artificial Sequence
  dgRNA
  Pcsk6
cgccaccgggccgcg

SEQ ID NO: 82096 - DNA, 15 bp, Artificial Sequence
  dgRNA
  Pcsk6
gccaccgggccgcgc

SEQ ID NO: 82097 - DNA, 15 bp, Artificial Sequence
  dgRNA
  Pcsk6
accgggccgcgcggg

SEQ ID NO: 82098 - DNA, 15 bp, Artificial Sequence
  dgRNA
  Pcsk6
ggcgggaacgcgccg

SEQ ID NO: 82099 - DNA, 15 bp, Artificial Sequence
  dgRNA
  Llgl1
gagcaaggggcggca

SEQ ID NO: 82100 - DNA, 15 bp, Artificial Sequence
  dgRNA
  Llgl1
aggggcggcacggca

SEQ ID NO: 82101 - DNA, 15 bp, Artificial Sequence
  dgRNA
  Llgl1
ggcggcacggcacgg

SEQ ID NO: 82102 - DNA, 15 bp, Artificial Sequence
  dgRNA
  Llgl1
gcggcacggcacggc

SEQ ID NO: 82103 - DNA, 15 bp, Artificial Sequence
  dgRNA
  Olfr16
accaaatctagcagc

SEQ ID NO: 82104 - DNA, 15 bp, Artificial Sequence
  dgRNA
  Olfr16
accggctgctagatt

SEQ ID NO: 82105 - DNA, 15 bp, Artificial Sequence
  dgRNA
  Dusp14
cgccagctcagaagc

SEQ ID NO: 82106 - DNA, 15 bp, Artificial Sequence
  dgRNA
  Dusp14
ggccggaggacaacg

SEQ ID NO: 82107 - DNA, 15 bp, Artificial Sequence
  dgRNA
  Dusp14
gacaacgcggcttca

SEQ ID NO: 82108 - DNA, 15 bp, Artificial Sequence
  dgRNA
  Dusp14
gcggcttcaaggagc

SEQ ID NO: 82109 - DNA, 15 bp, Artificial Sequence
  dgRNA
  Cntrl
tccactagtccgtgt

SEQ ID NO: 82110 - DNA, 15 bp, Artificial Sequence
  dgRNA
  Cntrl
ccactagtccgtgtc

SEQ ID NO: 82111 - DNA, 15 bp, Artificial Sequence
  dgRNA
  Cntrl
cactagtccgtgtcg

SEQ ID NO: 82112 - DNA, 15 bp, Artificial Sequence
  dgRNA
  Cntrl
actagtccgtgtcgg

SEQ ID NO: 82113 - DNA, 15 bp, Artificial Sequence
  dgRNA
  Ppp1r12a
cgagcgtctcctccc

SEQ ID NO: 82114 - DNA, 15 bp, Artificial Sequence
  dgRNA
  Ppp1r12a
ctcctccccggctcg

SEQ ID NO: 82115 - DNA, 15 bp, Artificial Sequence
  dgRNA
  Ppp1r12a
ggctccgctccgctc

SEQ ID NO: 82116 - DNA, 15 bp, Artificial Sequence
  dgRNA
  Ppp1r12a
tttctgtcgccgacg

SEQ ID NO: 82117 - DNA, 15 bp, Artificial Sequence
  dgRNA
  Defb25
gactagtccatgcag

SEQ ID NO: 82118 - DNA, 15 bp, Artificial Sequence
  dgRNA
  Defb25
agccttgggaccacg

SEQ ID NO: 82119 - DNA, 15 bp, Artificial Sequence
  dgRNA
  Defb25
gcagcccataaaagc

SEQ ID NO: 82120 - DNA, 15 bp, Artificial Sequence
  dgRNA
  Defb25
tgcaaggcgttgggg

SEQ ID NO: 82121 - DNA, 15 bp, Artificial Sequence
  dgRNA
  Cnot4
taccctaatgtaaga

SEQ ID NO: 82122 - DNA, 15 bp, Artificial Sequence
  dgRNA
  Cnot4
tggcccgtctagccg

SEQ ID NO: 82123 - DNA, 15 bp, Artificial Sequence
  dgRNA
  Cnot4
ctctctcagccgtaa

SEQ ID NO: 82124 - DNA, 15 bp, Artificial Sequence
  dgRNA
  Cnot4
caccatcttacatta

SEQ ID NO: 82125 - DNA, 15 bp, Artificial Sequence
  dgRNA
  Lrrc27
tcactcgacctcctt

SEQ ID NO: 82126 - DNA, 15 bp, Artificial Sequence
  dgRNA
  Lrrc27
cactcgacctccttc

SEQ ID NO: 82127 - DNA, 15 bp, Artificial Sequence
  dgRNA
  Lrrc27
ctcgaagtttctttc

SEQ ID NO: 82128 - DNA, 15 bp, Artificial Sequence
  dgRNA
  Lrrc27
cacctccagcataag

SEQ ID NO: 82129 - DNA, 15 bp, Artificial Sequence
  dgRNA
  G2e3
cctccgcggacgtgc

SEQ ID NO: 82130 - DNA, 15 bp, Artificial Sequence
  dgRNA
  G2e3
gcggacgtgcaggac

SEQ ID NO: 82131 - DNA, 15 bp, Artificial Sequence
  dgRNA
  G2e3
cggacgtgcaggacc

SEQ ID NO: 82132 - DNA, 15 bp, Artificial Sequence
  dgRNA
  G2e3
cgggagttgttttcc

SEQ ID NO: 82133 - DNA, 15 bp, Artificial Sequence
  dgRNA
  Fam134c
cgccccttctccgcc

SEQ ID NO: 82134 - DNA, 15 bp, Artificial Sequence
  dgRNA
  Fam134c
ggccgggcggagaag

SEQ ID NO: 82135 - DNA, 15 bp, Artificial Sequence
  dgRNA
  Fam134c
cggccgggcggagaa

SEQ ID NO: 82136 - DNA, 15 bp, Artificial Sequence
  dgRNA
  Fam134c
gcggccgggcggaga

SEQ ID NO: 82137 - DNA, 15 bp, Artificial Sequence
  dgRNA
  Mrps18a
ccaatctgtcctgac

SEQ ID NO: 82138 - DNA, 15 bp, Artificial Sequence
  dgRNA
  Mrps18a
actaaggaaaccggg

SEQ ID NO: 82139 - DNA, 15 bp, Artificial Sequence
  dgRNA
  Mrps18a
gtaatttacagacag

SEQ ID NO: 82140 - DNA, 15 bp, Artificial Sequence
  dgRNA
  Mrps18a
cctcccgccgcacag

SEQ ID NO: 82141 - DNA, 15 bp, Artificial Sequence
  dgRNA
  Map1b
gaggcaaccaccacg

SEQ ID NO: 82142 - DNA, 15 bp, Artificial Sequence
  dgRNA
  Map1b
accacgaggacgtgc

SEQ ID NO: 82143 - DNA, 15 bp, Artificial Sequence
  dgRNA
  Map1b
ccacgaggacgtgcc

SEQ ID NO: 82144 - DNA, 15 bp, Artificial Sequence
  dgRNA
  Map1b
cgaggacgtgccggg

SEQ ID NO: 82145 - DNA, 15 bp, Artificial Sequence
  dgRNA
  Olfr605
gctctaattaaaact

SEQ ID NO: 82146 - DNA, 15 bp, Artificial Sequence
  dgRNA
  Olfr605
ttggggggataatcc

SEQ ID NO: 82147 - DNA, 15 bp, Artificial Sequence
  dgRNA
  Olfr605
gcactctgtacgaag

SEQ ID NO: 82148 - DNA, 15 bp, Artificial Sequence
  dgRNA
  Olfr605
gtgcatgttttgcta

SEQ ID NO: 82149 - DNA, 15 bp, Artificial Sequence
  dgRNA
  Emc3
acactagaacaagtc

SEQ ID NO: 82150 - DNA, 15 bp, Artificial Sequence
  dgRNA
  Emc3
agggccgtctgactt

SEQ ID NO: 82151 - DNA, 15 bp, Artificial Sequence
  dgRNA
  Emc3
taccatctcgctccc

SEQ ID NO: 82152 - DNA, 15 bp, Artificial Sequence
  dgRNA
  Emc3
ttcccgctagaagaa

SEQ ID NO: 82153 - DNA, 15 bp, Artificial Sequence
  dgRNA
  Dut
tcccaactaccggcg

SEQ ID NO: 82154 - DNA, 15 bp, Artificial Sequence
  dgRNA
  Dut
cccaactaccggcga

SEQ ID NO: 82155 - DNA, 15 bp, Artificial Sequence
  dgRNA
  Dut
ccaactaccggcgag

SEQ ID NO: 82156 - DNA, 15 bp, Artificial Sequence
  dgRNA
  Dut
caactaccggcgagg

SEQ ID NO: 82157 - DNA, 15 bp, Artificial Sequence
  dgRNA
  Olfr531
tgccatgcgatactg

SEQ ID NO: 82158 - DNA, 15 bp, Artificial Sequence
  dgRNA
  Olfr531
tgcgatactgaggtt

SEQ ID NO: 82159 - DNA, 15 bp, Artificial Sequence
  dgRNA
  Olfr531
gcgatactgaggttt

SEQ ID NO: 82160 - DNA, 15 bp, Artificial Sequence
  dgRNA
  Olfr531
gagtctcaccatatc

SEQ ID NO: 82161 - DNA, 15 bp, Artificial Sequence
  dgRNA
  Stra6
cccgtggccacagct

SEQ ID NO: 82162 - DNA, 15 bp, Artificial Sequence
  dgRNA
  Stra6
agggggatcaagttt

SEQ ID NO: 82163 - DNA, 15 bp, Artificial Sequence
  dgRNA
  Stra6
gggggatcaagtttc

SEQ ID NO: 82164 - DNA, 15 bp, Artificial Sequence
  dgRNA
  Stra6
caagtttcgggcaaa

SEQ ID NO: 82165 - DNA, 15 bp, Artificial Sequence
  dgRNA
  Tgfb2
gtcgccctcccttac

SEQ ID NO: 82166 - DNA, 15 bp, Artificial Sequence
  dgRNA
  Tgfb2
atggtccagagctcg

SEQ ID NO: 82167 - DNA, 15 bp, Artificial Sequence
  dgRNA
  Tgfb2
tggtcttagtaacag

SEQ ID NO: 82168 - DNA, 15 bp, Artificial Sequence
  dgRNA
  Tgfb2
gcgtcactttgttga

SEQ ID NO: 82169 - DNA, 15 bp, Artificial Sequence
  dgRNA
  Rnf6
agtgaactacactaa

SEQ ID NO: 82170 - DNA, 15 bp, Artificial Sequence
  dgRNA
  Rnf6
actgggtagttaacc

SEQ ID NO: 82171 - DNA, 15 bp, Artificial Sequence
  dgRNA
  Rnf6
tccagacttcgtcaa

SEQ ID NO: 82172 - DNA, 15 bp, Artificial Sequence
  dgRNA
  Rnf6
ctgaaatacgagaag

SEQ ID NO: 82173 - DNA, 15 bp, Artificial Sequence
  dgRNA
  Cypt4
gacaggtagataacc

SEQ ID NO: 82174 - DNA, 15 bp, Artificial Sequence
  dgRNA
  Cypt4
caccttgagtatgaa

SEQ ID NO: 82175 - DNA, 15 bp, Artificial Sequence
  dgRNA
  Krt25
gataaacactaacct

SEQ ID NO: 82176 - DNA, 15 bp, Artificial Sequence
  dgRNA
  Krt25
ataaacactaaccta

SEQ ID NO: 82177 - DNA, 15 bp, Artificial Sequence
  dgRNA
  Krt25
taaacactaacctag

SEQ ID NO: 82178 - DNA, 15 bp, Artificial Sequence
  dgRNA
  Krt25
tacgttaacttgctg

SEQ ID NO: 82179 - DNA, 15 bp, Artificial Sequence
  dgRNA
  Pard6a
tcagctctcgaatcc

SEQ ID NO: 82180 - DNA, 15 bp, Artificial Sequence
  dgRNA
  Pard6a
cagctctcgaatcca

SEQ ID NO: 82181 - DNA, 15 bp, Artificial Sequence
  dgRNA
  Pard6a
cgaatccagggctgt

SEQ ID NO: 82182 - DNA, 15 bp, Artificial Sequence
  dgRNA
  Pard6a
ccagcaaccctgaat

SEQ ID NO: 82183 - DNA, 15 bp, Artificial Sequence
  dgRNA
  Dnajb3
tgttcgccctaccat

SEQ ID NO: 82184 - DNA, 15 bp, Artificial Sequence
  dgRNA
  Dnajb3
caaggatactagact

SEQ ID NO: 82185 - DNA, 15 bp, Artificial Sequence
  dgRNA
  Dnajb3
agcacaacggatccc

SEQ ID NO: 82186 - DNA, 15 bp, Artificial Sequence
  dgRNA
  Dnajb3
gcacaacggatccct

SEQ ID NO: 82187 - DNA, 15 bp, Artificial Sequence
  dgRNA
  Olfr384
taacatctctctact

SEQ ID NO: 82188 - DNA, 15 bp, Artificial Sequence
  dgRNA
  Ins2
cctaggactaagtag

SEQ ID NO: 82189 - DNA, 15 bp, Artificial Sequence
  dgRNA
  Ins2
gcagacctagcacca

SEQ ID NO: 82190 - DNA, 15 bp, Artificial Sequence
  dgRNA
  Ins2
acctggagcccttaa

SEQ ID NO: 82191 - DNA, 15 bp, Artificial Sequence
  dgRNA
  Ins2
cctggagcccttaat

SEQ ID NO: 82192 - DNA, 15 bp, Artificial Sequence
  dgRNA
  8030462N17Rik
taccggatcgaacgg

SEQ ID NO: 82193 - DNA, 15 bp, Artificial Sequence
  dgRNA
  8030462N17Rik
accggatcgaacgga

SEQ ID NO: 82194 - DNA, 15 bp, Artificial Sequence
  dgRNA
  8030462N17Rik
gcgcgcgcgaaagcc

SEQ ID NO: 82195 - DNA, 15 bp, Artificial Sequence
  dgRNA
  8030462N17Rik
cgcgcgcgaaagccc

SEQ ID NO: 82196 - DNA, 15 bp, Artificial Sequence
  dgRNA
  1810009J06Rik
cctttagagaatacc

SEQ ID NO: 82197 - DNA, 15 bp, Artificial Sequence
  dgRNA
  1810009J06Rik
ctttagagaataccg

SEQ ID NO: 82198 - DNA, 15 bp, Artificial Sequence
  dgRNA
  1810009J06Rik
tttagagaataccgg

SEQ ID NO: 82199 - DNA, 15 bp, Artificial Sequence
  dgRNA
  1810009J06Rik
cccggtattctctaa

SEQ ID NO: 82200 - DNA, 15 bp, Artificial Sequence
  dgRNA
  Ppp1r15a
gttcgcgtacttgct

SEQ ID NO: 82201 - DNA, 15 bp, Artificial Sequence
  dgRNA
  Ppp1r15a
attacgtgagatcga

SEQ ID NO: 82202 - DNA, 15 bp, Artificial Sequence
  dgRNA
  Ppp1r15a
ctctcgattgagcct

SEQ ID NO: 82203 - DNA, 15 bp, Artificial Sequence
  dgRNA
  Ppp1r15a
tctcgattgagccta

SEQ ID NO: 82204 - DNA, 15 bp, Artificial Sequence
  dgRNA
  Tcl1b1
taattccctgaagtc

SEQ ID NO: 82205 - DNA, 15 bp, Artificial Sequence
  dgRNA
  Tcl1b1
gctcaactcaccagg

SEQ ID NO: 82206 - DNA, 15 bp, Artificial Sequence
  dgRNA
  Tbc1d14
aggctaaggctatac

SEQ ID NO: 82207 - DNA, 15 bp, Artificial Sequence
  dgRNA
  Tbc1d14
taaggctataccggg

SEQ ID NO: 82208 - DNA, 15 bp, Artificial Sequence
  dgRNA
  Tbc1d14
aaggctataccggga

SEQ ID NO: 82209 - DNA, 15 bp, Artificial Sequence
  dgRNA
  Tbc1d14
cgggagggcattcca

SEQ ID NO: 82210 - DNA, 15 bp, Artificial Sequence
  dgRNA
  Numbl
gcgcctcaacctgag

SEQ ID NO: 82211 - DNA, 15 bp, Artificial Sequence
  dgRNA
  Numbl
tctagggatgcgtgc

SEQ ID NO: 82212 - DNA, 15 bp, Artificial Sequence
  dgRNA
  Numbl
cgcaaggccagacca

SEQ ID NO: 82213 - DNA, 15 bp, Artificial Sequence
  dgRNA
  Numbl
gggccggcctttgct

SEQ ID NO: 82214 - DNA, 15 bp, Artificial Sequence
  dgRNA
  Defb36
tggcatttgtgtgcg

SEQ ID NO: 82215 - DNA, 15 bp, Artificial Sequence
  dgRNA
  Defb36
cgtggcgcccccttg

SEQ ID NO: 82216 - DNA, 15 bp, Artificial Sequence
  dgRNA
  Defb36
gagacgcagagctgt

SEQ ID NO: 82217 - DNA, 15 bp, Artificial Sequence
  dgRNA
  Defb36
gcgtctcattatcca

SEQ ID NO: 82218 - DNA, 15 bp, Artificial Sequence
  dgRNA
  Spag5
tggccgttatgaaac

SEQ ID NO: 82219 - DNA, 15 bp, Artificial Sequence
  dgRNA
  Spag5
tggacagcccaaccc

SEQ ID NO: 82220 - DNA, 15 bp, Artificial Sequence
  dgRNA
  Spag5
gaagtgcggctcact

SEQ ID NO: 82221 - DNA, 15 bp, Artificial Sequence
  dgRNA
  Spag5
ggctcactcggtaac

SEQ ID NO: 82222 - DNA, 15 bp, Artificial Sequence
  dgRNA
  Coro7
gcagcaattgaagtg

SEQ ID NO: 82223 - DNA, 15 bp, Artificial Sequence
  dgRNA
  Coro7
tgtggttccttcggt

SEQ ID NO: 82224 - DNA, 15 bp, Artificial Sequence
  dgRNA
  Coro7
tcggtaggacagctg

SEQ ID NO: 82225 - DNA, 15 bp, Artificial Sequence
  dgRNA
  Coro7
gtgcagtagtccccc

SEQ ID NO: 82226 - DNA, 15 bp, Artificial Sequence
  dgRNA
  Slc6a6
ccaccagcgtttgga

SEQ ID NO: 82227 - DNA, 15 bp, Artificial Sequence
  dgRNA
  Slc6a6
tgcgcgcgctcgacg

SEQ ID NO: 82228 - DNA, 15 bp, Artificial Sequence
  dgRNA
  Slc6a6
cgacgaggcgagctc

SEQ ID NO: 82229 - DNA, 15 bp, Artificial Sequence
  dgRNA
  Slc6a6
cgcgcgccccgtgtg

SEQ ID NO: 82230 - DNA, 15 bp, Artificial Sequence
  dgRNA
  Magohb
aagcgctcgagatcg

SEQ ID NO: 82231 - DNA, 15 bp, Artificial Sequence
  dgRNA
  Magohb
gatttcgttccctac

SEQ ID NO: 82232 - DNA, 15 bp, Artificial Sequence
  dgRNA
  Magohb
gagtaaacgcgccct

SEQ ID NO: 82233 - DNA, 15 bp, Artificial Sequence
  dgRNA
  Magohb
actgaaggttcgcat

SEQ ID NO: 82234 - DNA, 15 bp, Artificial Sequence
  dgRNA
  Arhgap6
aaccgtccagagctg

SEQ ID NO: 82235 - DNA, 15 bp, Artificial Sequence
  dgRNA
  Arhgap6
accgtccagagctgc

SEQ ID NO: 82236 - DNA, 15 bp, Artificial Sequence
  dgRNA
  Arhgap6
cgggtctgacaccag

SEQ ID NO: 82237 - DNA, 15 bp, Artificial Sequence
  dgRNA
  Arhgap6
ttgcagaaacgtgtg

SEQ ID NO: 82238 - DNA, 15 bp, Artificial Sequence
  dgRNA
  Gart
catcagctctaatcg

SEQ ID NO: 82239 - DNA, 15 bp, Artificial Sequence
  dgRNA
  Gart
tctaatcgtggtgcc

SEQ ID NO: 82240 - DNA, 15 bp, Artificial Sequence
  dgRNA
  Gart
ctaatcgtggtgcca

SEQ ID NO: 82241 - DNA, 15 bp, Artificial Sequence
  dgRNA
  Gart
attctgagcccggct

SEQ ID NO: 82242 - DNA, 15 bp, Artificial Sequence
  dgRNA
  Cwf19l1
acacgccccatagct

SEQ ID NO: 82243 - DNA, 15 bp, Artificial Sequence
  dgRNA
  Cwf19l1
atggggcgtgtagag

SEQ ID NO: 82244 - DNA, 15 bp, Artificial Sequence
  dgRNA
  Cwf19l1
tatggggcgtgtaga

SEQ ID NO: 82245 - DNA, 15 bp, Artificial Sequence
  dgRNA
  Cwf19l1
ctatggggcgtgtag

SEQ ID NO: 82246 - DNA, 15 bp, Artificial Sequence
  dgRNA
  Ssu2
acttccacgtgagct

SEQ ID NO: 82247 - DNA, 15 bp, Artificial Sequence
  dgRNA
  Ssu2
gtaaaaggcctctta

SEQ ID NO: 82248 - DNA, 15 bp, Artificial Sequence
  dgRNA
  Ssu2
taaaaggcctcttat

SEQ ID NO: 82249 - DNA, 15 bp, Artificial Sequence
  dgRNA
  Ssu2
cttatgggactctca

SEQ ID NO: 82250 - DNA, 15 bp, Artificial Sequence
  dgRNA
  Tpgs2
atgtgaagcgaagcc

SEQ ID NO: 82251 - DNA, 15 bp, Artificial Sequence
  dgRNA
  Tpgs2
tgtgaagcgaagccc

SEQ ID NO: 82252 - DNA, 15 bp, Artificial Sequence
  dgRNA
  Tpgs2
agcgaagcccgggcc

SEQ ID NO: 82253 - DNA, 15 bp, Artificial Sequence
  dgRNA
  Tpgs2
gcgaagcccgggcca

SEQ ID NO: 82254 - DNA, 15 bp, Artificial Sequence
  dgRNA
  Neu2
gcctttcggttctga

SEQ ID NO: 82255 - DNA, 15 bp, Artificial Sequence
  dgRNA
  Neu2
tcggttctgaaggct

SEQ ID NO: 82256 - DNA, 15 bp, Artificial Sequence
  dgRNA
  Neu2
gcctctgaataagct

SEQ ID NO: 82257 - DNA, 15 bp, Artificial Sequence
  dgRNA
  Neu2
cctctgaataagctt

SEQ ID NO: 82258 - DNA, 15 bp, Artificial Sequence
  dgRNA
  Hscb
gccttcctccccggc

SEQ ID NO: 82259 - DNA, 15 bp, Artificial Sequence
  dgRNA
  Hscb
ccgcgattagtctca

SEQ ID NO: 82260 - DNA, 15 bp, Artificial Sequence
  dgRNA
  Hscb
cgggactcgacgtct

SEQ ID NO: 82261 - DNA, 15 bp, Artificial Sequence
  dgRNA
  Hscb
cgtcttggtttcccg

SEQ ID NO: 82262 - DNA, 15 bp, Artificial Sequence
  dgRNA
  Tmlhe
accgactatactact

SEQ ID NO: 82263 - DNA, 15 bp, Artificial Sequence
  dgRNA
  Tmlhe
tccactctgcacgaa

SEQ ID NO: 82264 - DNA, 15 bp, Artificial Sequence
  dgRNA
  Tmlhe
ctctgcacgaacgga

SEQ ID NO: 82265 - DNA, 15 bp, Artificial Sequence
  dgRNA
  Tmlhe
cacgaacggaaggag

SEQ ID NO: 82266 - DNA, 15 bp, Artificial Sequence
  dgRNA
  Pdcl
atttgtctcgaaact

SEQ ID NO: 82267 - DNA, 15 bp, Artificial Sequence
  dgRNA
  Pdcl
cctgaattggattgc

SEQ ID NO: 82268 - DNA, 15 bp, Artificial Sequence
  dgRNA
  Pdcl
cgagacaaattacaa

SEQ ID NO: 82269 - DNA, 15 bp, Artificial Sequence
  dgRNA
  Pdcl
tacgggtcttagctt

SEQ ID NO: 82270 - DNA, 15 bp, Artificial Sequence
  dgRNA
  Zscan29
atccccgcagtccac

SEQ ID NO: 82271 - DNA, 15 bp, Artificial Sequence
  dgRNA
  Zscan29
tccccgcagtccacc

SEQ ID NO: 82272 - DNA, 15 bp, Artificial Sequence
  dgRNA
  Zscan29
gcagtccaccgggag

SEQ ID NO: 82273 - DNA, 15 bp, Artificial Sequence
  dgRNA
  Zscan29
ccgcgcgccgcatcc

SEQ ID NO: 82274 - DNA, 15 bp, Artificial Sequence
  dgRNA
  Msi2
cggagatctggggct

SEQ ID NO: 82275 - DNA, 15 bp, Artificial Sequence
  dgRNA
  Msi2
cgctccgcttcgctg

SEQ ID NO: 82276 - DNA, 15 bp, Artificial Sequence
  dgRNA
  Msi2
gctccgcttcgctgt

SEQ ID NO: 82277 - DNA, 15 bp, Artificial Sequence
  dgRNA
  Msi2
ctccgcttcgctgtg

SEQ ID NO: 82278 - DNA, 15 bp, Artificial Sequence
  dgRNA
  Olfr329-ps
tcaacaactataaac

SEQ ID NO: 82279 - DNA, 15 bp, Artificial Sequence
  dgRNA
  Olfr329-ps
ataaactgggtcagc

SEQ ID NO: 82280 - DNA, 15 bp, Artificial Sequence
  dgRNA
  Olfr329-ps
gaacatagactaggg

SEQ ID NO: 82281 - DNA, 15 bp, Artificial Sequence
  dgRNA
  Olfr329-ps
tagggaacatagact

SEQ ID NO: 82282 - DNA, 15 bp, Artificial Sequence
  dgRNA
  Bace2
catatccgttagccg

SEQ ID NO: 82283 - DNA, 15 bp, Artificial Sequence
  dgRNA
  Bace2
ttagccgtggcctcc

SEQ ID NO: 82284 - DNA, 15 bp, Artificial Sequence
  dgRNA
  Bace2
tagccgtggcctccc

SEQ ID NO: 82285 - DNA, 15 bp, Artificial Sequence
  dgRNA
  Bace2
ctcccgggcacgttc

SEQ ID NO: 82286 - DNA, 15 bp, Artificial Sequence
  dgRNA
  Pla2g3
cgcggacacgatgag

SEQ ID NO: 82287 - DNA, 15 bp, Artificial Sequence
  dgRNA
  Pla2g3
ggacacgatgagtgg

SEQ ID NO: 82288 - DNA, 15 bp, Artificial Sequence
  dgRNA
  Pla2g3
cgatgagtggaggcg

SEQ ID NO: 82289 - DNA, 15 bp, Artificial Sequence
  dgRNA
  Pla2g3
gatgagtggaggcgt

SEQ ID NO: 82290 - DNA, 15 bp, Artificial Sequence
  dgRNA
  Hus1
tttccccgcagccgc

SEQ ID NO: 82291 - DNA, 15 bp, Artificial Sequence
  dgRNA
  Hus1
ttccccgcagccgcc

SEQ ID NO: 82292 - DNA, 15 bp, Artificial Sequence
  dgRNA
  Hus1
cgggacgtgagagtc

SEQ ID NO: 82293 - DNA, 15 bp, Artificial Sequence
  dgRNA
  Hus1
gggacgtgagagtcc

SEQ ID NO: 82294 - DNA, 15 bp, Artificial Sequence
  dgRNA
  Bves
ccaaacaaggaagcg

SEQ ID NO: 82295 - DNA, 15 bp, Artificial Sequence
  dgRNA
  Bves
caaacaaggaagcgc

SEQ ID NO: 82296 - DNA, 15 bp, Artificial Sequence
  dgRNA
  Bves
gcgcgcgcacgcggt

SEQ ID NO: 82297 - DNA, 15 bp, Artificial Sequence
  dgRNA
  Bves
cgcacgcggtgggcc

SEQ ID NO: 82298 - DNA, 15 bp, Artificial Sequence
  dgRNA
  Celf6
actgggtagcacttg

SEQ ID NO: 82299 - DNA, 15 bp, Artificial Sequence
  dgRNA
  Celf6
tagcacttgtggcta

SEQ ID NO: 82300 - DNA, 15 bp, Artificial Sequence
  dgRNA
  Celf6
cggcaacgagcacat

SEQ ID NO: 82301 - DNA, 15 bp, Artificial Sequence
  dgRNA
  Celf6
aacgagcacattgga

SEQ ID NO: 82302 - DNA, 15 bp, Artificial Sequence
  dgRNA
  Zbtb7c
agtgcatgtgtggcg

SEQ ID NO: 82303 - DNA, 15 bp, Artificial Sequence
  dgRNA
  Zbtb7c
cgggtgcgagccagc

SEQ ID NO: 82304 - DNA, 15 bp, Artificial Sequence
  dgRNA
  Zbtb7c
gcgaccgcacacatc

SEQ ID NO: 82305 - DNA, 15 bp, Artificial Sequence
  dgRNA
  Zbtb7c
cgaccgcacacatcc

SEQ ID NO: 82306 - DNA, 15 bp, Artificial Sequence
  dgRNA
  Mtf2
ctctttgttcagcgc

SEQ ID NO: 82307 - DNA, 15 bp, Artificial Sequence
  dgRNA
  Mtf2
tgttcagcgctggtc

SEQ ID NO: 82308 - DNA, 15 bp, Artificial Sequence
  dgRNA
  Mtf2
gttcagcgctggtcc

SEQ ID NO: 82309 - DNA, 15 bp, Artificial Sequence
  dgRNA
  Mtf2
gctggtccgggacgc

SEQ ID NO: 82310 - DNA, 15 bp, Artificial Sequence
  dgRNA
  Fbn2
gcccccacccgctgg

SEQ ID NO: 82311 - DNA, 15 bp, Artificial Sequence
  dgRNA
  Fbn2
acccgctggcggtcc

SEQ ID NO: 82312 - DNA, 15 bp, Artificial Sequence
  dgRNA
  Fbn2
ggtcctggagtcgct

SEQ ID NO: 82313 - DNA, 15 bp, Artificial Sequence
  dgRNA
  Fbn2
gtcctggagtcgctc

SEQ ID NO: 82314 - DNA, 15 bp, Artificial Sequence
  dgRNA
  Dock7
tcttcccggtcgtgg

SEQ ID NO: 82315 - DNA, 15 bp, Artificial Sequence
  dgRNA
  Dock7
cccggtcgtggcggc

SEQ ID NO: 82316 - DNA, 15 bp, Artificial Sequence
  dgRNA
  Dock7
ccggtcgtggcggca

SEQ ID NO: 82317 - DNA, 15 bp, Artificial Sequence
  dgRNA
  Dock7
ggcagcgagggctcg

SEQ ID NO: 82318 - DNA, 15 bp, Artificial Sequence
  dgRNA
  Mas1
tacctattgattgta

SEQ ID NO: 82319 - DNA, 15 bp, Artificial Sequence
  dgRNA
  Mas1
tcaagtgaggaatgt

SEQ ID NO: 82320 - DNA, 15 bp, Artificial Sequence
  dgRNA
  Mas1
gggaccctggcttat

SEQ ID NO: 82321 - DNA, 15 bp, Artificial Sequence
  dgRNA
  Mas1
cttgaagagggaccc

SEQ ID NO: 82322 - DNA, 15 bp, Artificial Sequence
  dgRNA
  Zfp622
aaccgctaagccctc

SEQ ID NO: 82323 - DNA, 15 bp, Artificial Sequence
  dgRNA
  Zfp622
cgctaagccctcagg

SEQ ID NO: 82324 - DNA, 15 bp, Artificial Sequence
  dgRNA
  Zfp622
gcagcggcatcctcc

SEQ ID NO: 82325 - DNA, 15 bp, Artificial Sequence
  dgRNA
  Zfp622
ccacctttgattgac

SEQ ID NO: 82326 - DNA, 15 bp, Artificial Sequence
  dgRNA
  Hist1h3g
aatagtactactgcg

SEQ ID NO: 82327 - DNA, 15 bp, Artificial Sequence
  dgRNA
  Hist1h3g
atagtactactgcgc

SEQ ID NO: 82328 - DNA, 15 bp, Artificial Sequence
  dgRNA
  Hist1h3g
gcagacacgcctatc

SEQ ID NO: 82329 - DNA, 15 bp, Artificial Sequence
  dgRNA
  Hist1h3g
caggatgcttctcgg

SEQ ID NO: 82330 - DNA, 15 bp, Artificial Sequence
  dgRNA
  Art1
ctgtgtggcgacagc

SEQ ID NO: 82331 - DNA, 15 bp, Artificial Sequence
  dgRNA
  Art1
ccgaatacagaggtg

SEQ ID NO: 82332 - DNA, 15 bp, Artificial Sequence
  dgRNA
  Art1
agctgccgaatacag

SEQ ID NO: 82333 - DNA, 15 bp, Artificial Sequence
  dgRNA
  Setd4
tctgcgtccgtaccc

SEQ ID NO: 82334 - DNA, 15 bp, Artificial Sequence
  dgRNA
  Setd4
accccggcttcgccg

SEQ ID NO: 82335 - DNA, 15 bp, Artificial Sequence
  dgRNA
  Setd4
tcgccgcggtttcta

SEQ ID NO: 82336 - DNA, 15 bp, Artificial Sequence
  dgRNA
  Setd4
gtttctaaggtaagc

SEQ ID NO: 82337 - DNA, 15 bp, Artificial Sequence
  dgRNA
  Gtpbp4
tggcggcggacttcc

SEQ ID NO: 82338 - DNA, 15 bp, Artificial Sequence
  dgRNA
  Gtpbp4
gacttcccggccgag

SEQ ID NO: 82339 - DNA, 15 bp, Artificial Sequence
  dgRNA
  Gtpbp4
acttcccggccgagc

SEQ ID NO: 82340 - DNA, 15 bp, Artificial Sequence
  dgRNA
  Gtpbp4
cttcccggccgagcg

SEQ ID NO: 82341 - DNA, 15 bp, Artificial Sequence
  dgRNA
  Ap1b1
cctacttgtgtgttc

SEQ ID NO: 82342 - DNA, 15 bp, Artificial Sequence
  dgRNA
  Ap1b1
tacgctgactgaaaa

SEQ ID NO: 82343 - DNA, 15 bp, Artificial Sequence
  dgRNA
  Ap1b1
tggttggtctcattt

SEQ ID NO: 82344 - DNA, 15 bp, Artificial Sequence
  dgRNA
  Ap1b1
ctgttggattatggt

SEQ ID NO: 82345 - DNA, 15 bp, Artificial Sequence
  dgRNA
  Dennd2d
atggtctgcaagcac

SEQ ID NO: 82346 - DNA, 15 bp, Artificial Sequence
  dgRNA
  Dennd2d
gtgaagatcagacta

SEQ ID NO: 82347 - DNA, 15 bp, Artificial Sequence
  dgRNA
  Atp6v1e2
tggccagccctccga

SEQ ID NO: 82348 - DNA, 15 bp, Artificial Sequence
  dgRNA
  Atp6v1e2
ggccagccctccgaa

SEQ ID NO: 82349 - DNA, 15 bp, Artificial Sequence
  dgRNA
  Atp6v1e2
gccagccctccgaag

SEQ ID NO: 82350 - DNA, 15 bp, Artificial Sequence
  dgRNA
  Atp6v1e2
tccgaaggggtagac

SEQ ID NO: 82351 - DNA, 15 bp, Artificial Sequence
  dgRNA
  Fam71b
ttggtctgatttgag

SEQ ID NO: 82352 - DNA, 15 bp, Artificial Sequence
  dgRNA
  Fam71b
ggggtgattgcttaa

SEQ ID NO: 82353 - DNA, 15 bp, Artificial Sequence
  dgRNA
  Fam71b
gggtgattgcttaaa

SEQ ID NO: 82354 - DNA, 15 bp, Artificial Sequence
  dgRNA
  Fam71b
gattgcttaaagggc

SEQ ID NO: 82355 - DNA, 15 bp, Artificial Sequence
  dgRNA
  Plp1
ggagtatcccaaagg

SEQ ID NO: 82356 - DNA, 15 bp, Artificial Sequence
  dgRNA
  Plp1
tatcccaaaggaggt

SEQ ID NO: 82357 - DNA, 15 bp, Artificial Sequence
  dgRNA
  Plp1
cccccttaaagagac

SEQ ID NO: 82358 - DNA, 15 bp, Artificial Sequence
  dgRNA
  Garnl3
catgtccatccaagc

SEQ ID NO: 82359 - DNA, 15 bp, Artificial Sequence
  dgRNA
  Garnl3
taagctaaaagagtg

SEQ ID NO: 82360 - DNA, 15 bp, Artificial Sequence
  dgRNA
  Garnl3
ttagcttaaagtgtg

SEQ ID NO: 82361 - DNA, 15 bp, Artificial Sequence
  dgRNA
  Atp13a4
ctatagctttcaaac

SEQ ID NO: 82362 - DNA, 15 bp, Artificial Sequence
  dgRNA
  Atp13a4
tatagctttcaaacg

SEQ ID NO: 82363 - DNA, 15 bp, Artificial Sequence
  dgRNA
  Atp13a4
cagaggcgggtacaa

SEQ ID NO: 82364 - DNA, 15 bp, Artificial Sequence
  dgRNA
  Atp13a4
ggcgggtacaaagga

SEQ ID NO: 82365 - DNA, 15 bp, Artificial Sequence
  dgRNA
  Gprc5c
ggcgatcggagtttc

SEQ ID NO: 82366 - DNA, 15 bp, Artificial Sequence
  dgRNA
  Rmnd5a
tctgggcggagcatc

SEQ ID NO: 82367 - DNA, 15 bp, Artificial Sequence
  dgRNA
  Rmnd5a
ctgggcggagcatcc

SEQ ID NO: 82368 - DNA, 15 bp, Artificial Sequence
  dgRNA
  Rmnd5a
tgggcggagcatccg

SEQ ID NO: 82369 - DNA, 15 bp, Artificial Sequence
  dgRNA
  Rmnd5a
cggagcatccgggga

SEQ ID NO: 82370 - DNA, 15 bp, Artificial Sequence
  dgRNA
  Notum
gcgccctgacccgtc

SEQ ID NO: 82371 - DNA, 15 bp, Artificial Sequence
  dgRNA
  Notum
cctgacccgtcgggc

SEQ ID NO: 82372 - DNA, 15 bp, Artificial Sequence
  dgRNA
  Notum
ctgacccgtcgggcc

SEQ ID NO: 82373 - DNA, 15 bp, Artificial Sequence
  dgRNA
  Notum
agctgcgcaacccgc

SEQ ID NO: 82374 - DNA, 15 bp, Artificial Sequence
  dgRNA
  Pip5k1a
aacgccgagaagctg

SEQ ID NO: 82375 - DNA, 15 bp, Artificial Sequence
  dgRNA
  Pip5k1a
gttcgtctatctagc

SEQ ID NO: 82376 - DNA, 15 bp, Artificial Sequence
  dgRNA
  Pip5k1a
tgcgccacagcttct

SEQ ID NO: 82377 - DNA, 15 bp, Artificial Sequence
  dgRNA
  Ddx18
attccgtcttccaat

SEQ ID NO: 82378 - DNA, 15 bp, Artificial Sequence
  dgRNA
  Ddx18
cattagcaaggcgaa

SEQ ID NO: 82379 - DNA, 15 bp, Artificial Sequence
  dgRNA
  Ddx18
attagcaaggcgaac

SEQ ID NO: 82380 - DNA, 15 bp, Artificial Sequence
  dgRNA
  Ddx18
cgtcctccagtcgcc

SEQ ID NO: 82381 - DNA, 15 bp, Artificial Sequence
  dgRNA
  Fli1
tcagggagcggatac

SEQ ID NO: 82382 - DNA, 15 bp, Artificial Sequence
  dgRNA
  Fli1
cagggagcggatact

SEQ ID NO: 82383 - DNA, 15 bp, Artificial Sequence
  dgRNA
  Fli1
agcggatactgggcg

SEQ ID NO: 82384 - DNA, 15 bp, Artificial Sequence
  dgRNA
  Fli1
ccccgtcattgttcc

SEQ ID NO: 82385 - DNA, 15 bp, Artificial Sequence
  dgRNA
  Heatr5b
ccggaaccagctccg

SEQ ID NO: 82386 - DNA, 15 bp, Artificial Sequence
  dgRNA
  Heatr5b
catgcgccgtgcaat

SEQ ID NO: 82387 - DNA, 15 bp, Artificial Sequence
  dgRNA
  Heatr5b
ccgtgcaattggcgc

SEQ ID NO: 82388 - DNA, 15 bp, Artificial Sequence
  dgRNA
  Heatr5b
attcgcttcgaaact

SEQ ID NO: 82389 - DNA, 15 bp, Artificial Sequence
  dgRNA
  Cpsf3l
caagctcggagcctg

SEQ ID NO: 82390 - DNA, 15 bp, Artificial Sequence
  dgRNA
  Cpsf3l
gccagccatcccaat

SEQ ID NO: 82391 - DNA, 15 bp, Artificial Sequence
  dgRNA
  Cpsf3l
atccgcctgcgtttc

SEQ ID NO: 82392 - DNA, 15 bp, Artificial Sequence
  dgRNA
  Cpsf3l
tgcgtttccggcgcg

SEQ ID NO: 82393 - DNA, 15 bp, Artificial Sequence
  dgRNA
  Ccng2
gagttgctaaggccc

SEQ ID NO: 82394 - DNA, 15 bp, Artificial Sequence
  dgRNA
  Ccng2
gacgcaacagccagt

SEQ ID NO: 82395 - DNA, 15 bp, Artificial Sequence
  dgRNA
  Ccng2
acccttgtccaatca

SEQ ID NO: 82396 - DNA, 15 bp, Artificial Sequence
  dgRNA
  Ccng2
gggagcccgctactt

SEQ ID NO: 82397 - DNA, 15 bp, Artificial Sequence
  dgRNA
  Gje1
atttgcagacatagg

SEQ ID NO: 82398 - DNA, 15 bp, Artificial Sequence
  dgRNA
  Gje1
cgtcatagatctctg

SEQ ID NO: 82399 - DNA, 15 bp, Artificial Sequence
  dgRNA
  Gje1
ttcgtcatagatctc

SEQ ID NO: 82400 - DNA, 15 bp, Artificial Sequence
  dgRNA
  Fkrp
tcgcatcgcccagac

SEQ ID NO: 82401 - DNA, 15 bp, Artificial Sequence
  dgRNA
  Fkrp
cgtcactcccactcg

SEQ ID NO: 82402 - DNA, 15 bp, Artificial Sequence
  dgRNA
  Fkrp
cccactcgcggctcc

SEQ ID NO: 82403 - DNA, 15 bp, Artificial Sequence
  dgRNA
  Fkrp
ggctcccggcagact

SEQ ID NO: 82404 - DNA, 15 bp, Artificial Sequence
  dgRNA
  Slx1b
acttccgcccttcct

SEQ ID NO: 82405 - DNA, 15 bp, Artificial Sequence
  dgRNA
  Slx1b
cttccgcccttccta

SEQ ID NO: 82406 - DNA, 15 bp, Artificial Sequence
  dgRNA
  Slx1b
ccgcccttcctaggg

SEQ ID NO: 82407 - DNA, 15 bp, Artificial Sequence
  dgRNA
  Slx1b
ctagggcggcttcga

SEQ ID NO: 82408 - DNA, 15 bp, Artificial Sequence
  dgRNA
  Emid1
gtcctggcagcgttg

SEQ ID NO: 82409 - DNA, 15 bp, Artificial Sequence
  dgRNA
  Emid1
tcctggcagcgttgc

SEQ ID NO: 82410 - DNA, 15 bp, Artificial Sequence
  dgRNA
  Emid1
cctggcagcgttgcg

SEQ ID NO: 82411 - DNA, 15 bp, Artificial Sequence
  dgRNA
  Emid1
agcgttgcggggacg

SEQ ID NO: 82412 - DNA, 15 bp, Artificial Sequence
  dgRNA
  Unc13a
gaaacgtggagacct

SEQ ID NO: 82413 - DNA, 15 bp, Artificial Sequence
  dgRNA
  Unc13a
cgtggagacctaggt

SEQ ID NO: 82414 - DNA, 15 bp, Artificial Sequence
  dgRNA
  Unc13a
cagaaatactcatcg

SEQ ID NO: 82415 - DNA, 15 bp, Artificial Sequence
  dgRNA
  Unc13a
gaaacagatacgacc

SEQ ID NO: 82416 - DNA, 15 bp, Artificial Sequence
  dgRNA
  2700094K13Rik
ggatccttgggtagg

SEQ ID NO: 82417 - DNA, 15 bp, Artificial Sequence
  dgRNA
  2700094K13Rik
aaaacccccagccaa

SEQ ID NO: 82418 - DNA, 15 bp, Artificial Sequence
  dgRNA
  2700094K13Rik
acccccagccaaagg

SEQ ID NO: 82419 - DNA, 15 bp, Artificial Sequence
  dgRNA
  2700094K13Rik
agtgctgtacaatgt

SEQ ID NO: 82420 - DNA, 15 bp, Artificial Sequence
  dgRNA
  Cryzl1
tgcgcgacagtagct

SEQ ID NO: 82421 - DNA, 15 bp, Artificial Sequence
  dgRNA
  Cryzl1
ttgcagaaagagcgt

SEQ ID NO: 82422 - DNA, 15 bp, Artificial Sequence
  dgRNA
  Cryzl1
gagcgtgggcacgaa

SEQ ID NO: 82423 - DNA, 15 bp, Artificial Sequence
  dgRNA
  Cryzl1
ggtaggggttacggt

SEQ ID NO: 82424 - DNA, 15 bp, Artificial Sequence
  dgRNA
  Ccdc73
agatctccgttttcg

SEQ ID NO: 82425 - DNA, 15 bp, Artificial Sequence
  dgRNA
  Ccdc73
gtagccgcacaaatg

SEQ ID NO: 82426 - DNA, 15 bp, Artificial Sequence
  dgRNA
  Ccdc73
atgcggactgaaaac

SEQ ID NO: 82427 - DNA, 15 bp, Artificial Sequence
  dgRNA
  Ccdc73
aaccggaagcgcctt

SEQ ID NO: 82428 - DNA, 15 bp, Artificial Sequence
  dgRNA
  Grip1
ggacaaggctgcgag

SEQ ID NO: 82429 - DNA, 15 bp, Artificial Sequence
  dgRNA
  Grip1
gataggagaactagg

SEQ ID NO: 82430 - DNA, 15 bp, Artificial Sequence
  dgRNA
  Tmem120a
aggcgcagcttctca

SEQ ID NO: 82431 - DNA, 15 bp, Artificial Sequence
  dgRNA
  Tmem120a
tctaatctctgcacg

SEQ ID NO: 82432 - DNA, 15 bp, Artificial Sequence
  dgRNA
  Tmem120a
cacgcggcgagtcag

SEQ ID NO: 82433 - DNA, 15 bp, Artificial Sequence
  dgRNA
  Tmem120a
cggcgagtcagaggc

SEQ ID NO: 82434 - DNA, 15 bp, Artificial Sequence
  dgRNA
  Nat10
ctgtaccagtggcaa

SEQ ID NO: 82435 - DNA, 15 bp, Artificial Sequence
  dgRNA
  Nat10
caaatgcgagacacc

SEQ ID NO: 82436 - DNA, 15 bp, Artificial Sequence
  dgRNA
  Nat10
ccgcctgtcatagcc

SEQ ID NO: 82437 - DNA, 15 bp, Artificial Sequence
  dgRNA
  Nat10
gttacccgcagcaaa

SEQ ID NO: 82438 - DNA, 15 bp, Artificial Sequence
  dgRNA
  Sidt2
actccagacgctcac

SEQ ID NO: 82439 - DNA, 15 bp, Artificial Sequence
  dgRNA
  Sidt2
cggcgacggctgcgt

SEQ ID NO: 82440 - DNA, 15 bp, Artificial Sequence
  dgRNA
  Sidt2
ctgcgtgggaagtag

SEQ ID NO: 82441 - DNA, 15 bp, Artificial Sequence
  dgRNA
  Sidt2
cctttaaatccgcgt

SEQ ID NO: 82442 - DNA, 15 bp, Artificial Sequence
  dgRNA
  Rhd
gtagaagctcccaac

SEQ ID NO: 82443 - DNA, 15 bp, Artificial Sequence
  dgRNA
  Rhd
acatccctccgagct

SEQ ID NO: 82444 - DNA, 15 bp, Artificial Sequence
  dgRNA
  Rhd
gataagacctttggc

SEQ ID NO: 82445 - DNA, 15 bp, Artificial Sequence
  dgRNA
  Rhd
agcttctactgggct

SEQ ID NO: 82446 - DNA, 15 bp, Artificial Sequence
  dgRNA
  Vmn2r37
aggggggtccttcca

SEQ ID NO: 82447 - DNA, 15 bp, Artificial Sequence
  dgRNA
  Rfx5
ctctttgggtataca

SEQ ID NO: 82448 - DNA, 15 bp, Artificial Sequence
  dgRNA
  Rfx5
tctttgggtatacaa

SEQ ID NO: 82449 - DNA, 15 bp, Artificial Sequence
  dgRNA
  Bin2
aaggtcctcccgtga

SEQ ID NO: 82450 - DNA, 15 bp, Artificial Sequence
  dgRNA
  Bin2
tcccgtgatggccag

SEQ ID NO: 82451 - DNA, 15 bp, Artificial Sequence
  dgRNA
  Bin2
cgtgatggccagtgg

SEQ ID NO: 82452 - DNA, 15 bp, Artificial Sequence
  dgRNA
  Bin2
gtcctctcgggaatc

SEQ ID NO: 82453 - DNA, 15 bp, Artificial Sequence
  dgRNA
  Lce1e
cttaggcatgagata

SEQ ID NO: 82454 - DNA, 15 bp, Artificial Sequence
  dgRNA
  Lce1e
attagagcatgactt

SEQ ID NO: 82455 - DNA, 15 bp, Artificial Sequence
  dgRNA
  Lce1e
ctactgacagtcaca

SEQ ID NO: 82456 - DNA, 15 bp, Artificial Sequence
  dgRNA
  Cyp19a1
cacagccaaaccgct

SEQ ID NO: 82457 - DNA, 15 bp, Artificial Sequence
  dgRNA
  Cyp19a1
gttctgttcaacagt

SEQ ID NO: 82458 - DNA, 15 bp, Artificial Sequence
  dgRNA
  Cyp19a1
ccagcggtttggctg

SEQ ID NO: 82459 - DNA, 15 bp, Artificial Sequence
  dgRNA
  Cyp19a1
cgtaacccagcggtt

SEQ ID NO: 82460 - DNA, 15 bp, Artificial Sequence
  dgRNA
  Pcgf6
gcttccttcaaggcg

SEQ ID NO: 82461 - DNA, 15 bp, Artificial Sequence
  dgRNA
  Pcgf6
agctccgcctcacct

SEQ ID NO: 82462 - DNA, 15 bp, Artificial Sequence
  dgRNA
  Pcgf6
gcctctgcggagcgc

SEQ ID NO: 82463 - DNA, 15 bp, Artificial Sequence
  dgRNA
  Pcgf6
ccggcgcctgcgcac

SEQ ID NO: 82464 - DNA, 15 bp, Artificial Sequence
  dgRNA
  Foxa1
ctttccctagccgcg

SEQ ID NO: 82465 - DNA, 15 bp, Artificial Sequence
  dgRNA
  Foxa1
cggcgctggcgcggc

SEQ ID NO: 82466 - DNA, 15 bp, Artificial Sequence
  dgRNA
  Foxa1
gcgcggcggctggac

SEQ ID NO: 82467 - DNA, 15 bp, Artificial Sequence
  dgRNA
  Foxa1
gaccccctttggaaa

SEQ ID NO: 82468 - DNA, 15 bp, Artificial Sequence
  dgRNA
  Nubpl
gtgctatatgtgaaa

SEQ ID NO: 82469 - DNA, 15 bp, Artificial Sequence
  dgRNA
  Nubpl
atcaggctcatctcc

SEQ ID NO: 82470 - DNA, 15 bp, Artificial Sequence
  dgRNA
  Nubpl
ggaaggggacgccaa

SEQ ID NO: 82471 - DNA, 15 bp, Artificial Sequence
  dgRNA
  Nubpl
ttggcgtccccttcc

SEQ ID NO: 82472 - DNA, 15 bp, Artificial Sequence
  dgRNA
  Olfr444
tagggtggaaccttg

SEQ ID NO: 82473 - DNA, 15 bp, Artificial Sequence
  dgRNA
  Olfr444
ctagggtggaacctt

SEQ ID NO: 82474 - DNA, 15 bp, Artificial Sequence
  dgRNA
  Olfr444
gtgcatcacctaggg

SEQ ID NO: 82475 - DNA, 15 bp, Artificial Sequence
  dgRNA
  Duoxa2
cgcgccaccgctagc

SEQ ID NO: 82476 - DNA, 15 bp, Artificial Sequence
  dgRNA
  Duoxa2
tttgcggtcgagtta

SEQ ID NO: 82477 - DNA, 15 bp, Artificial Sequence
  dgRNA
  Duoxa2
ggtcgagttaaggac

SEQ ID NO: 82478 - DNA, 15 bp, Artificial Sequence
  dgRNA
  Duoxa2
tgacctcaaccagac

SEQ ID NO: 82479 - DNA, 15 bp, Artificial Sequence
  dgRNA
  P2ry6
aaactgatggtccga

SEQ ID NO: 82480 - DNA, 15 bp, Artificial Sequence
  dgRNA
  P2ry6
acggtccccatcgct

SEQ ID NO: 82481 - DNA, 15 bp, Artificial Sequence
  dgRNA
  P2ry6
catcgctaggctgag

SEQ ID NO: 82482 - DNA, 15 bp, Artificial Sequence
  dgRNA
  P2ry6
atcgctaggctgagt

SEQ ID NO: 82483 - DNA, 15 bp, Artificial Sequence
  dgRNA
  Sbpl
attgtcacagtacac

SEQ ID NO: 82484 - DNA, 15 bp, Artificial Sequence
  dgRNA
  Sbpl
cttcacgagagccca

SEQ ID NO: 82485 - DNA, 15 bp, Artificial Sequence
  dgRNA
  Sbpl
gcttcacgagagccc

SEQ ID NO: 82486 - DNA, 15 bp, Artificial Sequence
  dgRNA
  Serpina1f
ggctgcaatagccac

SEQ ID NO: 82487 - DNA, 15 bp, Artificial Sequence
  dgRNA
  Serpina1f
gctgcaatagccaca

SEQ ID NO: 82488 - DNA, 15 bp, Artificial Sequence
  dgRNA
  Serpina1f
cgtctcccttcaaaa

SEQ ID NO: 82489 - DNA, 15 bp, Artificial Sequence
  dgRNA
  Serpina1f
tcccttcaaaaaggt

SEQ ID NO: 82490 - DNA, 15 bp, Artificial Sequence
  dgRNA
  Gdap1l1
caactgtgagcgctc

SEQ ID NO: 82491 - DNA, 15 bp, Artificial Sequence
  dgRNA
  Gdap1l1
aactgtgagcgctct

SEQ ID NO: 82492 - DNA, 15 bp, Artificial Sequence
  dgRNA
  Gdap1l1
ctgtgagcgctctgg

SEQ ID NO: 82493 - DNA, 15 bp, Artificial Sequence
  dgRNA
  Gdap1l1
tgtgagcgctctggg

SEQ ID NO: 82494 - DNA, 15 bp, Artificial Sequence
  dgRNA
  Nrl
ataccctttaacttc

SEQ ID NO: 82495 - DNA, 15 bp, Artificial Sequence
  dgRNA
  Nrl
ctactatccctgctt

SEQ ID NO: 82496 - DNA, 15 bp, Artificial Sequence
  dgRNA
  Nrl
gcttcggcccctact

SEQ ID NO: 82497 - DNA, 15 bp, Artificial Sequence
  dgRNA
  Nrl
cttcggcccctacta

SEQ ID NO: 82498 - DNA, 15 bp, Artificial Sequence
  dgRNA
  Atp8a1
cctcggccctccttg

SEQ ID NO: 82499 - DNA, 15 bp, Artificial Sequence
  dgRNA
  Atp8a1
cttctcggcccacct

SEQ ID NO: 82500 - DNA, 15 bp, Artificial Sequence
  dgRNA
  Gm16286
ggaggacgcggtgtt

SEQ ID NO: 82501 - DNA, 15 bp, Artificial Sequence
  dgRNA
  Gm16286
gaggacgcggtgttt

SEQ ID NO: 82502 - DNA, 15 bp, Artificial Sequence
  dgRNA
  Gm16286
ggtgtttgggccgcg

SEQ ID NO: 82503 - DNA, 15 bp, Artificial Sequence
  dgRNA
  Gm16286
gtgtttgggccgcgt

SEQ ID NO: 82504 - DNA, 15 bp, Artificial Sequence
  dgRNA
  Zfp217
ggcaagattgagtcc

SEQ ID NO: 82505 - DNA, 15 bp, Artificial Sequence
  dgRNA
  Zfp217
ccatttccggttgcc

SEQ ID NO: 82506 - DNA, 15 bp, Artificial Sequence
  dgRNA
  Zfp217
tccttgcaagcccat

SEQ ID NO: 82507 - DNA, 15 bp, Artificial Sequence
  dgRNA
  Zfp217
tgcaagcccattggt

SEQ ID NO: 82508 - DNA, 15 bp, Artificial Sequence
  dgRNA
  Notch1
ccttagatcctggct

SEQ ID NO: 82509 - DNA, 15 bp, Artificial Sequence
  dgRNA
  Notch1
acgcgctccctagcc

SEQ ID NO: 82510 - DNA, 15 bp, Artificial Sequence
  dgRNA
  Notch1
ctccctagcccggac

SEQ ID NO: 82511 - DNA, 15 bp, Artificial Sequence
  dgRNA
  Notch1
aacccaccaaagcgc

SEQ ID NO: 82512 - DNA, 15 bp, Artificial Sequence
  dgRNA
  Cpz
tcttatgggaggctc

SEQ ID NO: 82513 - DNA, 15 bp, Artificial Sequence
  dgRNA
  Cpz
ttgccctcttatggg

SEQ ID NO: 82514 - DNA, 15 bp, Artificial Sequence
  dgRNA
  Cpz
gacttgccctcttat

SEQ ID NO: 82515 - DNA, 15 bp, Artificial Sequence
  dgRNA
  Cpz
ggacttgccctctta

SEQ ID NO: 82516 - DNA, 15 bp, Artificial Sequence
  dgRNA
  Fam228b
cgcaggttcctagta

SEQ ID NO: 82517 - DNA, 15 bp, Artificial Sequence
  dgRNA
  Fam228b
tcccgccgctgcctt

SEQ ID NO: 82518 - DNA, 15 bp, Artificial Sequence
  dgRNA
  Fam228b
cgccgctgccttcgg

SEQ ID NO: 82519 - DNA, 15 bp, Artificial Sequence
  dgRNA
  Fam228b
ggaggactaattgat

SEQ ID NO: 82520 - DNA, 15 bp, Artificial Sequence
  dgRNA
  Klf10
gccgctgatcacgcg

SEQ ID NO: 82521 - DNA, 15 bp, Artificial Sequence
  dgRNA
  Klf10
acctttgccgctgat

SEQ ID NO: 82522 - DNA, 15 bp, Artificial Sequence
  dgRNA
  Klf10
tgattggtcgacact

SEQ ID NO: 82523 - DNA, 15 bp, Artificial Sequence
  dgRNA
  Klf10
cctctaccccgcccg

SEQ ID NO: 82524 - DNA, 15 bp, Artificial Sequence
  dgRNA
  Dut
gccgctctgctccgc

SEQ ID NO: 82525 - DNA, 15 bp, Artificial Sequence
  dgRNA
  Dut
ccgcgggcgtgcgct

SEQ ID NO: 82526 - DNA, 15 bp, Artificial Sequence
  dgRNA
  Dut
cgcgggcgtgcgctc

SEQ ID NO: 82527 - DNA, 15 bp, Artificial Sequence
  dgRNA
  Dut
ggcgtgcgctcgggt

SEQ ID NO: 82528 - DNA, 15 bp, Artificial Sequence
  dgRNA
  Lpcat2b
tagtgaaggagaacg

SEQ ID NO: 82529 - DNA, 15 bp, Artificial Sequence
  dgRNA
  Lpcat2b
gtcatagtaacctct

SEQ ID NO: 82530 - DNA, 15 bp, Artificial Sequence
  dgRNA
  Lpcat2b
ttttattgtgcctag

SEQ ID NO: 82531 - DNA, 15 bp, Artificial Sequence
  dgRNA
  Drc1
ttccatctgccttcg

SEQ ID NO: 82532 - DNA, 15 bp, Artificial Sequence
  dgRNA
  Drc1
tccatctgccttcgt

SEQ ID NO: 82533 - DNA, 15 bp, Artificial Sequence
  dgRNA
  Drc1
ccatctgccttcgtg

SEQ ID NO: 82534 - DNA, 15 bp, Artificial Sequence
  dgRNA
  Drc1
atcaagtccacattt

SEQ ID NO: 82535 - DNA, 15 bp, Artificial Sequence
  dgRNA
  Olfr1497
tgtcttagccctcac

SEQ ID NO: 82536 - DNA, 15 bp, Artificial Sequence
  dgRNA
  Olfr1497
ctattataggaggca

SEQ ID NO: 82537 - DNA, 15 bp, Artificial Sequence
  dgRNA
  Olfr1497
ggatagttctattat

SEQ ID NO: 82538 - DNA, 15 bp, Artificial Sequence
  dgRNA
  Olfr1497
gaagtttacctgtga

SEQ ID NO: 82539 - DNA, 15 bp, Artificial Sequence
  dgRNA
  Btnl9
tctaacgaagttccc

SEQ ID NO: 82540 - DNA, 15 bp, Artificial Sequence
  dgRNA
  Btnl9
agatttttttccacg

SEQ ID NO: 82541 - DNA, 15 bp, Artificial Sequence
  dgRNA
  Btnl9
ttttttccacgagga

SEQ ID NO: 82542 - DNA, 15 bp, Artificial Sequence
  dgRNA
  Btnl9
tttttccacgaggac

SEQ ID NO: 82543 - DNA, 15 bp, Artificial Sequence
  dgRNA
  Fam160b2
ccaccgccctccatc

SEQ ID NO: 82544 - DNA, 15 bp, Artificial Sequence
  dgRNA
  Fam160b2
cgcccccgagccctc

SEQ ID NO: 82545 - DNA, 15 bp, Artificial Sequence
  dgRNA
  Fam160b2
ccgagccctccggca

SEQ ID NO: 82546 - DNA, 15 bp, Artificial Sequence
  dgRNA
  Fam160b2
cgagccctccggcag

SEQ ID NO: 82547 - DNA, 15 bp, Artificial Sequence
  dgRNA
  Tmem150b
ttacgaatctgagac

SEQ ID NO: 82548 - DNA, 15 bp, Artificial Sequence
  dgRNA
  Tmem150b
ggacactcttgcttc

SEQ ID NO: 82549 - DNA, 15 bp, Artificial Sequence
  dgRNA
  Tmem150b
ctcagattcgtaaaa

SEQ ID NO: 82550 - DNA, 15 bp, Artificial Sequence
  dgRNA
  Tmem150b
tctcagattcgtaaa

SEQ ID NO: 82551 - DNA, 15 bp, Artificial Sequence
  dgRNA
  Zfyve21
acactctccctagag

SEQ ID NO: 82552 - DNA, 15 bp, Artificial Sequence
  dgRNA
  Zfyve21
tccctagaggggcga

SEQ ID NO: 82553 - DNA, 15 bp, Artificial Sequence
  dgRNA
  Zfyve21
gcgagggtgcccctc

SEQ ID NO: 82554 - DNA, 15 bp, Artificial Sequence
  dgRNA
  Zfyve21
gtcttcaccgccgat

SEQ ID NO: 82555 - DNA, 15 bp, Artificial Sequence
  dgRNA
  Sprr2e
ttgctcccactcgac

SEQ ID NO: 82556 - DNA, 15 bp, Artificial Sequence
  dgRNA
  Sprr2e
gatagtcctataaat

SEQ ID NO: 82557 - DNA, 15 bp, Artificial Sequence
  dgRNA
  Sprr2e
gggactctacgaaat

SEQ ID NO: 82558 - DNA, 15 bp, Artificial Sequence
  dgRNA
  Sprr2e
tgggactctacgaaa

SEQ ID NO: 82559 - DNA, 15 bp, Artificial Sequence
  dgRNA
  Rragd
tcccgcaggctggag

SEQ ID NO: 82560 - DNA, 15 bp, Artificial Sequence
  dgRNA
  Rragd
agtaccgcacagttg

SEQ ID NO: 82561 - DNA, 15 bp, Artificial Sequence
  dgRNA
  Rragd
gtaccgcacagttga

SEQ ID NO: 82562 - DNA, 15 bp, Artificial Sequence
  dgRNA
  Rragd
taccgcacagttgag

SEQ ID NO: 82563 - DNA, 15 bp, Artificial Sequence
  dgRNA
  Peli2
cacgctccaactttt

SEQ ID NO: 82564 - DNA, 15 bp, Artificial Sequence
  dgRNA
  Peli2
gctccaacttttcgg

SEQ ID NO: 82565 - DNA, 15 bp, Artificial Sequence
  dgRNA
  Peli2
agagctgccccttta

SEQ ID NO: 82566 - DNA, 15 bp, Artificial Sequence
  dgRNA
  Peli2
tgtttacataacacg

SEQ ID NO: 82567 - DNA, 15 bp, Artificial Sequence
  dgRNA
  Slc25a41
tggttaggtaccatt

SEQ ID NO: 82568 - DNA, 15 bp, Artificial Sequence
  dgRNA
  Slc25a41
ttaggtaccattcgg

SEQ ID NO: 82569 - DNA, 15 bp, Artificial Sequence
  dgRNA
  Slc25a41
ttcggaggaccacac

SEQ ID NO: 82570 - DNA, 15 bp, Artificial Sequence
  dgRNA
  Slc25a41
tccccctaaaccgca

SEQ ID NO: 82571 - DNA, 15 bp, Artificial Sequence
  dgRNA
  Tex261
gaaaattaggatcca

SEQ ID NO: 82572 - DNA, 15 bp, Artificial Sequence
  dgRNA
  Tex261
tggttccaatcaatc

SEQ ID NO: 82573 - DNA, 15 bp, Artificial Sequence
  dgRNA
  Tex261
ggttccaatcaatct

SEQ ID NO: 82574 - DNA, 15 bp, Artificial Sequence
  dgRNA
  Tex261
gtaggcgctccgtac

SEQ ID NO: 82575 - DNA, 15 bp, Artificial Sequence
  dgRNA
  Gabrg1
ccacagggcactacc

SEQ ID NO: 82576 - DNA, 15 bp, Artificial Sequence
  dgRNA
  Gabrg1
cacagggcactacct

SEQ ID NO: 82577 - DNA, 15 bp, Artificial Sequence
  dgRNA
  Gabrg1
ggggctctcaattga

SEQ ID NO: 82578 - DNA, 15 bp, Artificial Sequence
  dgRNA
  Gabrg1
ccaggtagtgccctg

SEQ ID NO: 82579 - DNA, 15 bp, Artificial Sequence
  dgRNA
  Psmb8
ctcaatgaaatggat

SEQ ID NO: 82580 - DNA, 15 bp, Artificial Sequence
  dgRNA
  Psmb8
gacgtcagcagttcc

SEQ ID NO: 82581 - DNA, 15 bp, Artificial Sequence
  dgRNA
  Psmb8
acgtcagcagttcct

SEQ ID NO: 82582 - DNA, 15 bp, Artificial Sequence
  dgRNA
  Psmb8
cgacgtgagcagccc

SEQ ID NO: 82583 - DNA, 15 bp, Artificial Sequence
  dgRNA
  Osbpl9
cgccctatacacaat

SEQ ID NO: 82584 - DNA, 15 bp, Artificial Sequence
  dgRNA
  Osbpl9
ttgactaggattgcc

SEQ ID NO: 82585 - DNA, 15 bp, Artificial Sequence
  dgRNA
  Osbpl9
ggattgccaggggcg

SEQ ID NO: 82586 - DNA, 15 bp, Artificial Sequence
  dgRNA
  Osbpl9
gattgccaggggcgt

SEQ ID NO: 82587 - DNA, 15 bp, Artificial Sequence
  dgRNA
  Eya4
ggacgcccggccacc

SEQ ID NO: 82588 - DNA, 15 bp, Artificial Sequence
  dgRNA
  Eya4
ctcgctaacgccgct

SEQ ID NO: 82589 - DNA, 15 bp, Artificial Sequence
  dgRNA
  Eya4
cgccgctcggctgct

SEQ ID NO: 82590 - DNA, 15 bp, Artificial Sequence
  dgRNA
  Eya4
cggctgctcggactt

SEQ ID NO: 82591 - DNA, 15 bp, Artificial Sequence
  dgRNA
  Cnga4
cggggacctcattaa

SEQ ID NO: 82592 - DNA, 15 bp, Artificial Sequence
  dgRNA
  Cnga4
gtccccggaggtggt

SEQ ID NO: 82593 - DNA, 15 bp, Artificial Sequence
  dgRNA
  Cnga4
tgaggtccccggagg

SEQ ID NO: 82594 - DNA, 15 bp, Artificial Sequence
  dgRNA
  Cnga4
taatgaggtccccgg

SEQ ID NO: 82595 - DNA, 15 bp, Artificial Sequence
  dgRNA
  Klhdc9
cggtttctagccttt

SEQ ID NO: 82596 - DNA, 15 bp, Artificial Sequence
  dgRNA
  Klhdc9
gagcccaaatccttt

SEQ ID NO: 82597 - DNA, 15 bp, Artificial Sequence
  dgRNA
  Klhdc9
atcactgtaagatcg

SEQ ID NO: 82598 - DNA, 15 bp, Artificial Sequence
  dgRNA
  Klhdc9
cgcggtagcttaacc

SEQ ID NO: 82599 - DNA, 15 bp, Artificial Sequence
  dgRNA
  Traf2
cgtctgtccgtcaga

SEQ ID NO: 82600 - DNA, 15 bp, Artificial Sequence
  dgRNA
  Traf2
gtctgtccgtcagac

SEQ ID NO: 82601 - DNA, 15 bp, Artificial Sequence
  dgRNA
  Traf2
tctgtccgtcagacg

SEQ ID NO: 82602 - DNA, 15 bp, Artificial Sequence
  dgRNA
  Traf2
gtccgtcagacgggg

SEQ ID NO: 82603 - DNA, 15 bp, Artificial Sequence
  dgRNA
  1700001J03Rik
ccccttttgtataaa

SEQ ID NO: 82604 - DNA, 15 bp, Artificial Sequence
  dgRNA
  1700001J03Rik
gggtaaggctactgc

SEQ ID NO: 82605 - DNA, 15 bp, Artificial Sequence
  dgRNA
  Olfr71
ctaaacgactgtact

SEQ ID NO: 82606 - DNA, 15 bp, Artificial Sequence
  dgRNA
  Olfr71
tccgtgtgaggaagg

SEQ ID NO: 82607 - DNA, 15 bp, Artificial Sequence
  dgRNA
  Olfr71
tcatccgtgtgagga

SEQ ID NO: 82608 - DNA, 15 bp, Artificial Sequence
  dgRNA
  Olfr71
cagttcatccgtgtg

SEQ ID NO: 82609 - DNA, 15 bp, Artificial Sequence
  dgRNA
  Zfp697
ctactacagcccgac

SEQ ID NO: 82610 - DNA, 15 bp, Artificial Sequence
  dgRNA
  Zfp697
tactacagcccgaca

SEQ ID NO: 82611 - DNA, 15 bp, Artificial Sequence
  dgRNA
  Zfp697
cccccgttgttgctg

SEQ ID NO: 82612 - DNA, 15 bp, Artificial Sequence
  dgRNA
  Zfp697
ccgttgttgctgcgg

SEQ ID NO: 82613 - DNA, 15 bp, Artificial Sequence
  dgRNA
  Lpar4
gggcaatgctcttta

SEQ ID NO: 82614 - DNA, 15 bp, Artificial Sequence
  dgRNA
  Lpar4
cttcagtccagcgat

SEQ ID NO: 82615 - DNA, 15 bp, Artificial Sequence
  dgRNA
  Lpar4
cagtccagcgattgg

SEQ ID NO: 82616 - DNA, 15 bp, Artificial Sequence
  dgRNA
  Lpar4
gattggtggtgacta

SEQ ID NO: 82617 - DNA, 15 bp, Artificial Sequence
  dgRNA
  Pnpla6
agcggaataatttaa

SEQ ID NO: 82618 - DNA, 15 bp, Artificial Sequence
  dgRNA
  Pnpla6
aaggtgccgcgtctg

SEQ ID NO: 82619 - DNA, 15 bp, Artificial Sequence
  dgRNA
  Pnpla6
ccgcgtctgaggcag

SEQ ID NO: 82620 - DNA, 15 bp, Artificial Sequence
  dgRNA
  Pnpla6
cgcgtctgaggcagc

SEQ ID NO: 82621 - DNA, 15 bp, Artificial Sequence
  dgRNA
  B230219D22Rik
acgatgcctgcgtca

SEQ ID NO: 82622 - DNA, 15 bp, Artificial Sequence
  dgRNA
  B230219D22Rik
agtgaccctgcattc

SEQ ID NO: 82623 - DNA, 15 bp, Artificial Sequence
  dgRNA
  B230219D22Rik
gtgaccctgcattct

SEQ ID NO: 82624 - DNA, 15 bp, Artificial Sequence
  dgRNA
  B230219D22Rik
tccgctcgctcatct

SEQ ID NO: 82625 - DNA, 15 bp, Artificial Sequence
  dgRNA
  Anxa11
agagcggctttgctc

SEQ ID NO: 82626 - DNA, 15 bp, Artificial Sequence
  dgRNA
  Anxa11
ttgctccggaaagct

SEQ ID NO: 82627 - DNA, 15 bp, Artificial Sequence
  dgRNA
  Anxa11
tgctccggaaagctc

SEQ ID NO: 82628 - DNA, 15 bp, Artificial Sequence
  dgRNA
  Anxa11
gctccggaaagctcg

SEQ ID NO: 82629 - DNA, 15 bp, Artificial Sequence
  dgRNA
  Gzmb
caccctatgcccttg

SEQ ID NO: 82630 - DNA, 15 bp, Artificial Sequence
  dgRNA
  Gzmb
ctgagtcattcgctg

SEQ ID NO: 82631 - DNA, 15 bp, Artificial Sequence
  dgRNA
  Gzmb
tgagtcattcgctgt

SEQ ID NO: 82632 - DNA, 15 bp, Artificial Sequence
  dgRNA
  Gzmb
aagacgtcatcaggc

SEQ ID NO: 82633 - DNA, 15 bp, Artificial Sequence
  dgRNA
  Polr2h
ccctcggccggcacg

SEQ ID NO: 82634 - DNA, 15 bp, Artificial Sequence
  dgRNA
  Polr2h
cggcacgcggacttc

SEQ ID NO: 82635 - DNA, 15 bp, Artificial Sequence
  dgRNA
  Polr2h
ggcacgcggacttca

SEQ ID NO: 82636 - DNA, 15 bp, Artificial Sequence
  dgRNA
  Polr2h
cgcggacttcaggga

SEQ ID NO: 82637 - DNA, 15 bp, Artificial Sequence
  dgRNA
  Olfr1402
ggtccaaagttggct

SEQ ID NO: 82638 - DNA, 15 bp, Artificial Sequence
  dgRNA
  Olfr1402
atactgatcatatga

SEQ ID NO: 82639 - DNA, 15 bp, Artificial Sequence
  dgRNA
  Olfr1402
tactggacatgaccc

SEQ ID NO: 82640 - DNA, 15 bp, Artificial Sequence
  dgRNA
  Olfr1402
tgcatggctgataag

SEQ ID NO: 82641 - DNA, 15 bp, Artificial Sequence
  dgRNA
  Olfr1305
agccaacctctgatt

SEQ ID NO: 82642 - DNA, 15 bp, Artificial Sequence
  dgRNA
  Olfr1305
ctactcactatgaaa

SEQ ID NO: 82643 - DNA, 15 bp, Artificial Sequence
  dgRNA
  Pla2g4e
gccagacgaaatgag

SEQ ID NO: 82644 - DNA, 15 bp, Artificial Sequence
  dgRNA
  Pla2g4e
acgaaatgagaggca

SEQ ID NO: 82645 - DNA, 15 bp, Artificial Sequence
  dgRNA
  Pla2g4e
gcaacaattgagcaa

SEQ ID NO: 82646 - DNA, 15 bp, Artificial Sequence
  dgRNA
  Pla2g4e
gcctctcatttcgtc

SEQ ID NO: 82647 - DNA, 15 bp, Artificial Sequence
  dgRNA
  Fchsd2
accccccgggccgcc

SEQ ID NO: 82648 - DNA, 15 bp, Artificial Sequence
  dgRNA
  Fchsd2
gcggagacggccagg

SEQ ID NO: 82649 - DNA, 15 bp, Artificial Sequence
  dgRNA
  Fchsd2
ggcggagacggccag

SEQ ID NO: 82650 - DNA, 15 bp, Artificial Sequence
  dgRNA
  Fchsd2
aggcggagacggcca

SEQ ID NO: 82651 - DNA, 15 bp, Artificial Sequence
  dgRNA
  Gm7694
tactggagagttcat

SEQ ID NO: 82652 - DNA, 15 bp, Artificial Sequence
  dgRNA
  Gm7694
gaacttggtctctcc

SEQ ID NO: 82653 - DNA, 15 bp, Artificial Sequence
  dgRNA
  Gm7694
tatctaagtcaaaac

SEQ ID NO: 82654 - DNA, 15 bp, Artificial Sequence
  dgRNA
  Gm7694
gggtatggcaaaccc

SEQ ID NO: 82655 - DNA, 15 bp, Artificial Sequence
  dgRNA
  Lilra6
agcacggtcctgagg

SEQ ID NO: 82656 - DNA, 15 bp, Artificial Sequence
  dgRNA
  Rbm11
acgactgatgccctc

SEQ ID NO: 82657 - DNA, 15 bp, Artificial Sequence
  dgRNA
  Rbm11
ggtgggcgggtcccg

SEQ ID NO: 82658 - DNA, 15 bp, Artificial Sequence
  dgRNA
  Rbm11
gtgggcgggtcccgc

SEQ ID NO: 82659 - DNA, 15 bp, Artificial Sequence
  dgRNA
  Rbm11
gcgggtcccgcggga

SEQ ID NO: 82660 - DNA, 15 bp, Artificial Sequence
  dgRNA
  Abt1
acggaagtattttac

SEQ ID NO: 82661 - DNA, 15 bp, Artificial Sequence
  dgRNA
  Abt1
cggaagtattttacc

SEQ ID NO: 82662 - DNA, 15 bp, Artificial Sequence
  dgRNA
  Abt1
attttaccgggaccc

SEQ ID NO: 82663 - DNA, 15 bp, Artificial Sequence
  dgRNA
  Abt1
cgcccctccgcaccc

SEQ ID NO: 82664 - DNA, 15 bp, Artificial Sequence
  dgRNA
  Olfr961
agacattcaatcatc

SEQ ID NO: 82665 - DNA, 15 bp, Artificial Sequence
  dgRNA
  Olfr961
tttagatcacagggg

SEQ ID NO: 82666 - DNA, 15 bp, Artificial Sequence
  dgRNA
  Olfr961
tagagtttagatcac

SEQ ID NO: 82667 - DNA, 15 bp, Artificial Sequence
  dgRNA
  Gpr89
tttgagtctacccag

SEQ ID NO: 82668 - DNA, 15 bp, Artificial Sequence
  dgRNA
  Gpr89
ggcaaacggagaatg

SEQ ID NO: 82669 - DNA, 15 bp, Artificial Sequence
  dgRNA
  Gpr89
aatgcggccgctgat

SEQ ID NO: 82670 - DNA, 15 bp, Artificial Sequence
  dgRNA
  Gpr89
ttagtaggcacaagg

SEQ ID NO: 82671 - DNA, 15 bp, Artificial Sequence
  dgRNA
  Phldb2
ggtggccgcccccac

SEQ ID NO: 82672 - DNA, 15 bp, Artificial Sequence
  dgRNA
  Phldb2
gtggccgcccccacc

SEQ ID NO: 82673 - DNA, 15 bp, Artificial Sequence
  dgRNA
  Phldb2
gccgcccccaccggg

SEQ ID NO: 82674 - DNA, 15 bp, Artificial Sequence
  dgRNA
  Phldb2
ccgcccccaccggga

SEQ ID NO: 82675 - DNA, 15 bp, Artificial Sequence
  dgRNA
  Zfp286
aaccttccgttactg

SEQ ID NO: 82676 - DNA, 15 bp, Artificial Sequence
  dgRNA
  Zfp286
accttccgttactgc

SEQ ID NO: 82677 - DNA, 15 bp, Artificial Sequence
  dgRNA
  Zfp286
tttttctctcgcgag

SEQ ID NO: 82678 - DNA, 15 bp, Artificial Sequence
  dgRNA
  Zfp286
ttttctctcgcgaga

SEQ ID NO: 82679 - DNA, 15 bp, Artificial Sequence
  dgRNA
  Hmgb1
ctcagcctctcggcc

SEQ ID NO: 82680 - DNA, 15 bp, Artificial Sequence
  dgRNA
  Hmgb1
ctcgcagacagccaa

SEQ ID NO: 82681 - DNA, 15 bp, Artificial Sequence
  dgRNA
  Hmgb1
acagccaatggcgcg

SEQ ID NO: 82682 - DNA, 15 bp, Artificial Sequence
  dgRNA
  Hmgb1
cagccaatggcgcgc

SEQ ID NO: 82683 - DNA, 15 bp, Artificial Sequence
  dgRNA
  4930407I10Rik
tgcaagggcaacatc

SEQ ID NO: 82684 - DNA, 15 bp, Artificial Sequence
  dgRNA
  4930407I10Rik
ggctagatagcaggt

SEQ ID NO: 82685 - DNA, 15 bp, Artificial Sequence
  dgRNA
  4930407I10Rik
aaatggctagatagc

SEQ ID NO: 82686 - DNA, 15 bp, Artificial Sequence
  dgRNA
  4930407I10Rik
ctccatgtggtcaaa

SEQ ID NO: 82687 - DNA, 15 bp, Artificial Sequence
  dgRNA
  Zfp598
gcagtcatgagcgaa

SEQ ID NO: 82688 - DNA, 15 bp, Artificial Sequence
  dgRNA
  Zfp598
gctctgtacaacacc

SEQ ID NO: 82689 - DNA, 15 bp, Artificial Sequence
  dgRNA
  Zfp598
aacaccaggcccggg

SEQ ID NO: 82690 - DNA, 15 bp, Artificial Sequence
  dgRNA
  Zfp598
gtgcgcacttccgcc

SEQ ID NO: 82691 - DNA, 15 bp, Artificial Sequence
  dgRNA
  Lin28a
agggggctgcccgcg

SEQ ID NO: 82692 - DNA, 15 bp, Artificial Sequence
  dgRNA
  Lin28a
gggggctgcccgcgg

SEQ ID NO: 82693 - DNA, 15 bp, Artificial Sequence
  dgRNA
  Lin28a
ctgcccgcggggggt

SEQ ID NO: 82694 - DNA, 15 bp, Artificial Sequence
  dgRNA
  Lin28a
tgcccgcggggggtt

SEQ ID NO: 82695 - DNA, 15 bp, Artificial Sequence
  dgRNA
  Sipa1l1
taattgggttagaag

SEQ ID NO: 82696 - DNA, 15 bp, Artificial Sequence
  dgRNA
  Sipa1l1
atctttgaggtgaac

SEQ ID NO: 82697 - DNA, 15 bp, Artificial Sequence
  dgRNA
  4921524L21Rik
taaggatcttgatct

SEQ ID NO: 82698 - DNA, 15 bp, Artificial Sequence
  dgRNA
  4921524L21Rik
gtaaggatcttgatc

SEQ ID NO: 82699 - DNA, 15 bp, Artificial Sequence
  dgRNA
  Vcpip1
agtcgctttgcatca

SEQ ID NO: 82700 - DNA, 15 bp, Artificial Sequence
  dgRNA
  Vcpip1
actccttcgcgagag

SEQ ID NO: 82701 - DNA, 15 bp, Artificial Sequence
  dgRNA
  Vcpip1
tcgcgagagaggagc

SEQ ID NO: 82702 - DNA, 15 bp, Artificial Sequence
  dgRNA
  Vcpip1
ggagccggaagactc

SEQ ID NO: 82703 - DNA, 15 bp, Artificial Sequence
  dgRNA
  Ptprs
ttgcctgccgctacg

SEQ ID NO: 82704 - DNA, 15 bp, Artificial Sequence
  dgRNA
  Ptprs
gcccaaccccctagg

SEQ ID NO: 82705 - DNA, 15 bp, Artificial Sequence
  dgRNA
  Ptprs
tttagacaggcggac

SEQ ID NO: 82706 - DNA, 15 bp, Artificial Sequence
  dgRNA
  Ptprs
ttagacaggcggact

SEQ ID NO: 82707 - DNA, 15 bp, Artificial Sequence
  dgRNA
  Dcaf12l2
aacccccactcagac

SEQ ID NO: 82708 - DNA, 15 bp, Artificial Sequence
  dgRNA
  Dcaf12l2
gatgggcgcggagga

SEQ ID NO: 82709 - DNA, 15 bp, Artificial Sequence
  dgRNA
  Dcaf12l2
ttggccgtggggtgc

SEQ ID NO: 82710 - DNA, 15 bp, Artificial Sequence
  dgRNA
  Dcaf12l2
gggctgttggccgtg

SEQ ID NO: 82711 - DNA, 15 bp, Artificial Sequence
  dgRNA
  Wdr24
cagggagcccaattc

SEQ ID NO: 82712 - DNA, 15 bp, Artificial Sequence
  dgRNA
  Wdr24
cgctgttcgcagaca

SEQ ID NO: 82713 - DNA, 15 bp, Artificial Sequence
  dgRNA
  Wdr24
gacacggaactctta

SEQ ID NO: 82714 - DNA, 15 bp, Artificial Sequence
  dgRNA
  Wdr24
gttgtcactcacttc

SEQ ID NO: 82715 - DNA, 15 bp, Artificial Sequence
  dgRNA
  Gch1
tccttttataagtcg

SEQ ID NO: 82716 - DNA, 15 bp, Artificial Sequence
  dgRNA
  Gch1
ccttttataagtcga

SEQ ID NO: 82717 - DNA, 15 bp, Artificial Sequence
  dgRNA
  Gch1
cttttataagtcgag

SEQ ID NO: 82718 - DNA, 15 bp, Artificial Sequence
  dgRNA
  Gch1
ttttataagtcgagg

SEQ ID NO: 82719 - DNA, 15 bp, Artificial Sequence
  dgRNA
  Arap2
ccccgccgttgagct

SEQ ID NO: 82720 - DNA, 15 bp, Artificial Sequence
  dgRNA
  Arap2
cccgccgttgagctc

SEQ ID NO: 82721 - DNA, 15 bp, Artificial Sequence
  dgRNA
  Arap2
tcgggccgcccccgc

SEQ ID NO: 82722 - DNA, 15 bp, Artificial Sequence
  dgRNA
  Arap2
gcggatccccgcccc

SEQ ID NO: 82723 - DNA, 15 bp, Artificial Sequence
  dgRNA
  Htr5b
ctctccgcccctcgg

SEQ ID NO: 82724 - DNA, 15 bp, Artificial Sequence
  dgRNA
  Htr5b
tccgcccctcggagg

SEQ ID NO: 82725 - DNA, 15 bp, Artificial Sequence
  dgRNA
  Htr5b
ccgcccctcggaggt

SEQ ID NO: 82726 - DNA, 15 bp, Artificial Sequence
  dgRNA
  Htr5b
agctacagctcctat

SEQ ID NO: 82727 - DNA, 15 bp, Artificial Sequence
  dgRNA
  Myl3
cctattgtgcatggt

SEQ ID NO: 82728 - DNA, 15 bp, Artificial Sequence
  dgRNA
  Myl3
ctattgtgcatggta

SEQ ID NO: 82729 - DNA, 15 bp, Artificial Sequence
  dgRNA
  Myl3
tattgtgcatggtag

SEQ ID NO: 82730 - DNA, 15 bp, Artificial Sequence
  dgRNA
  Myl3
cccagtcacctgttg

SEQ ID NO: 82731 - DNA, 15 bp, Artificial Sequence
  dgRNA
  Mpp3
gcaaaatcggattct

SEQ ID NO: 82732 - DNA, 15 bp, Artificial Sequence
  dgRNA
  Mpp3
aaatcggattctcgg

SEQ ID NO: 82733 - DNA, 15 bp, Artificial Sequence
  dgRNA
  Mpp3
gattctcggcggagc

SEQ ID NO: 82734 - DNA, 15 bp, Artificial Sequence
  dgRNA
  Mpp3
gtccaccgggagccg

SEQ ID NO: 82735 - DNA, 15 bp, Artificial Sequence
  dgRNA
  Nrsn2
agtaagggacaacgg

SEQ ID NO: 82736 - DNA, 15 bp, Artificial Sequence
  dgRNA
  Nrsn2
gtaagggacaacggt

SEQ ID NO: 82737 - DNA, 15 bp, Artificial Sequence
  dgRNA
  Nrsn2
taagggacaacggtg

SEQ ID NO: 82738 - DNA, 15 bp, Artificial Sequence
  dgRNA
  Nrsn2
tccgaccccggaggc

SEQ ID NO: 82739 - DNA, 15 bp, Artificial Sequence
  dgRNA
  Rsph6a
gagggcgccccgcgc

SEQ ID NO: 82740 - DNA, 15 bp, Artificial Sequence
  dgRNA
  Rsph6a
tactttaccagcgcg

SEQ ID NO: 82741 - DNA, 15 bp, Artificial Sequence
  dgRNA
  Rsph6a
ttactttaccagcgc

SEQ ID NO: 82742 - DNA, 15 bp, Artificial Sequence
  dgRNA
  Rsph6a
gttactttaccagcg

SEQ ID NO: 82743 - DNA, 15 bp, Artificial Sequence
  dgRNA
  Pak7
agtgcggctttgcaa

SEQ ID NO: 82744 - DNA, 15 bp, Artificial Sequence
  dgRNA
  Pak7
gtcctatagaaaatt

SEQ ID NO: 82745 - DNA, 15 bp, Artificial Sequence
  dgRNA
  Pak7
gcgggagtagcccgc

SEQ ID NO: 82746 - DNA, 15 bp, Artificial Sequence
  dgRNA
  Pak7
cgggagtagcccgca

SEQ ID NO: 82747 - DNA, 15 bp, Artificial Sequence
  dgRNA
  Rnf7
ttgtattaaactcgg

SEQ ID NO: 82748 - DNA, 15 bp, Artificial Sequence
  dgRNA
  Rnf7
attgtattaaactcg

SEQ ID NO: 82749 - DNA, 15 bp, Artificial Sequence
  dgRNA
  Ace2
tacaattgtctgccc

SEQ ID NO: 82750 - DNA, 15 bp, Artificial Sequence
  dgRNA
  Ace2
aataaagcgaagtag

SEQ ID NO: 82751 - DNA, 15 bp, Artificial Sequence
  dgRNA
  Ace2
tcacaatatacctgt

SEQ ID NO: 82752 - DNA, 15 bp, Artificial Sequence
  dgRNA
  Tmem51
cctgcgcgcacaaga

SEQ ID NO: 82753 - DNA, 15 bp, Artificial Sequence
  dgRNA
  Tmem51
ggtgagtttacagcc

SEQ ID NO: 82754 - DNA, 15 bp, Artificial Sequence
  dgRNA
  Tmem51
gtgaggtcgccgaac

SEQ ID NO: 82755 - DNA, 15 bp, Artificial Sequence
  dgRNA
  Tmem51
tgaggtcgccgaaca

SEQ ID NO: 82756 - DNA, 15 bp, Artificial Sequence
  dgRNA
  Olfr878
ctttaatcagtccat

SEQ ID NO: 82757 - DNA, 15 bp, Artificial Sequence
  dgRNA
  Olfr878
tctactggctactca

SEQ ID NO: 82758 - DNA, 15 bp, Artificial Sequence
  dgRNA
  Olfr878
gcagatgacttctac

SEQ ID NO: 82759 - DNA, 15 bp, Artificial Sequence
  dgRNA
  Olfr878
cttgcctaataaatg

SEQ ID NO: 82760 - DNA, 15 bp, Artificial Sequence
  dgRNA
  Cypt12
cctcaaaggggtcaa

SEQ ID NO: 82761 - DNA, 15 bp, Artificial Sequence
  dgRNA
  Cypt12
gtgtacctactgcca

SEQ ID NO: 82762 - DNA, 15 bp, Artificial Sequence
  dgRNA
  Cypt12
tatgccaggtatgtt

SEQ ID NO: 82763 - DNA, 15 bp, Artificial Sequence
  dgRNA
  Cypt12
gttctgcctacccaa

SEQ ID NO: 82764 - DNA, 15 bp, Artificial Sequence
  dgRNA
  Ccbl1
tctcggccgccacgc

SEQ ID NO: 82765 - DNA, 15 bp, Artificial Sequence
  dgRNA
  Ccbl1
cagccagtcgcgccg

SEQ ID NO: 82766 - DNA, 15 bp, Artificial Sequence
  dgRNA
  Ccbl1
agccagtcgcgccgt

SEQ ID NO: 82767 - DNA, 15 bp, Artificial Sequence
  dgRNA
  Ccbl1
cgcgccgtgggtctt

SEQ ID NO: 82768 - DNA, 15 bp, Artificial Sequence
  dgRNA
  Rplp2
tacagtgaagcgtca

SEQ ID NO: 82769 - DNA, 15 bp, Artificial Sequence
  dgRNA
  Rplp2
acagtgaagcgtcat

SEQ ID NO: 82770 - DNA, 15 bp, Artificial Sequence
  dgRNA
  Rplp2
cgccttaataagacc

SEQ ID NO: 82771 - DNA, 15 bp, Artificial Sequence
  dgRNA
  Rplp2
taataagaccagggc

SEQ ID NO: 82772 - DNA, 15 bp, Artificial Sequence
  dgRNA
  Brwd1
gtcgtgccacgccgc

SEQ ID NO: 82773 - DNA, 15 bp, Artificial Sequence
  dgRNA
  Brwd1
gccgccggctccccg

SEQ ID NO: 82774 - DNA, 15 bp, Artificial Sequence
  dgRNA
  Brwd1
ccgccggctccccgc

SEQ ID NO: 82775 - DNA, 15 bp, Artificial Sequence
  dgRNA
  Brwd1
cgccggctccccgcg

SEQ ID NO: 82776 - DNA, 15 bp, Artificial Sequence
  dgRNA
  Cyp2j6
actatagaagcagtc

SEQ ID NO: 82777 - DNA, 15 bp, Artificial Sequence
  dgRNA
  Cyp2j6
ctatagaagcagtct

SEQ ID NO: 82778 - DNA, 15 bp, Artificial Sequence
  dgRNA
  Cyp2j6
tgggtaaaagctcta

SEQ ID NO: 82779 - DNA, 15 bp, Artificial Sequence
  dgRNA
  Cyp2j6
gggtaaaagctctaa

SEQ ID NO: 82780 - DNA, 15 bp, Artificial Sequence
  dgRNA
  Ap3m1
actctcaccgtagtt

SEQ ID NO: 82781 - DNA, 15 bp, Artificial Sequence
  dgRNA
  Ap3m1
tcccgcccctcagtc

SEQ ID NO: 82782 - DNA, 15 bp, Artificial Sequence
  dgRNA
  Ap3m1
cgcccctcagtccgg

SEQ ID NO: 82783 - DNA, 15 bp, Artificial Sequence
  dgRNA
  Ap3m1
ctagtccataaccat

SEQ ID NO: 82784 - DNA, 15 bp, Artificial Sequence
  dgRNA
  Lrriq3
gcggggtccttggga

SEQ ID NO: 82785 - DNA, 15 bp, Artificial Sequence
  dgRNA
  Lrriq3
aggcgctctccgtgc

SEQ ID NO: 82786 - DNA, 15 bp, Artificial Sequence
  dgRNA
  Lrriq3
ggcgctctccgtgca

SEQ ID NO: 82787 - DNA, 15 bp, Artificial Sequence
  dgRNA
  Lrriq3
gcgctctccgtgcag

SEQ ID NO: 82788 - DNA, 15 bp, Artificial Sequence
  dgRNA
  Agap2
cgtgtcccctaatca

SEQ ID NO: 82789 - DNA, 15 bp, Artificial Sequence
  dgRNA
  Agap2
cgccctagcagacag

SEQ ID NO: 82790 - DNA, 15 bp, Artificial Sequence
  dgRNA
  Agap2
agcagacagcggtgt

SEQ ID NO: 82791 - DNA, 15 bp, Artificial Sequence
  dgRNA
  Agap2
gcagacagcggtgtt

SEQ ID NO: 82792 - DNA, 15 bp, Artificial Sequence
  dgRNA
  Klhl22
tcaataggcacctcg

SEQ ID NO: 82793 - DNA, 15 bp, Artificial Sequence
  dgRNA
  Klhl22
caataggcacctcga

SEQ ID NO: 82794 - DNA, 15 bp, Artificial Sequence
  dgRNA
  Klhl22
taggcacctcgaggg

SEQ ID NO: 82795 - DNA, 15 bp, Artificial Sequence
  dgRNA
  Klhl22
cgagggtggagcttc

SEQ ID NO: 82796 - DNA, 15 bp, Artificial Sequence
  dgRNA
  F5
tggggcggagaccct

SEQ ID NO: 82797 - DNA, 15 bp, Artificial Sequence
  dgRNA
  F5
ggggcggagaccctt

SEQ ID NO: 82798 - DNA, 15 bp, Artificial Sequence
  dgRNA
  F5
gccataacctccagc

SEQ ID NO: 82799 - DNA, 15 bp, Artificial Sequence
  dgRNA
  F5
ctacactaggcatag

SEQ ID NO: 82800 - DNA, 15 bp, Artificial Sequence
  dgRNA
  Birc2
ttctataagacgctg

SEQ ID NO: 82801 - DNA, 15 bp, Artificial Sequence
  dgRNA
  Prps1l1
gactttatagtctat

SEQ ID NO: 82802 - DNA, 15 bp, Artificial Sequence
  dgRNA
  Prps1l1
ctcaagccttttggg

SEQ ID NO: 82803 - DNA, 15 bp, Artificial Sequence
  dgRNA
  Prps1l1
gacctcaagcctttt

SEQ ID NO: 82804 - DNA, 15 bp, Artificial Sequence
  dgRNA
  Ptpn3
agactgacggccagg

SEQ ID NO: 82805 - DNA, 15 bp, Artificial Sequence
  dgRNA
  Ptpn3
gactgacggccaggt

SEQ ID NO: 82806 - DNA, 15 bp, Artificial Sequence
  dgRNA
  Ptpn3
cttcgccaatccctc

SEQ ID NO: 82807 - DNA, 15 bp, Artificial Sequence
  dgRNA
  Ptpn3
ttcgccaatccctct

SEQ ID NO: 82808 - DNA, 15 bp, Artificial Sequence
  dgRNA
  4930402F06Rik
taaagcacccagctt

SEQ ID NO: 82809 - DNA, 15 bp, Artificial Sequence
  dgRNA
  4930402F06Rik
ccagcttcggtattt

SEQ ID NO: 82810 - DNA, 15 bp, Artificial Sequence
  dgRNA
  4930402F06Rik
caaaataccgaagct

SEQ ID NO: 82811 - DNA, 15 bp, Artificial Sequence
  dgRNA
  4930402F06Rik
ccaaaataccgaagc

SEQ ID NO: 82812 - DNA, 15 bp, Artificial Sequence
  dgRNA
  Lsg1
aatggaaacagtcgt

SEQ ID NO: 82813 - DNA, 15 bp, Artificial Sequence
  dgRNA
  Lsg1
gtaggagtagccata

SEQ ID NO: 82814 - DNA, 15 bp, Artificial Sequence
  dgRNA
  Lsg1
ccgctgttacacttc

SEQ ID NO: 82815 - DNA, 15 bp, Artificial Sequence
  dgRNA
  Lsg1
gttacacttccggac

SEQ ID NO: 82816 - DNA, 15 bp, Artificial Sequence
  dgRNA
  Pex6
gtgcgtcgacaacaa

SEQ ID NO: 82817 - DNA, 15 bp, Artificial Sequence
  dgRNA
  Pex6
cgtcgacaacaacgg

SEQ ID NO: 82818 - DNA, 15 bp, Artificial Sequence
  dgRNA
  Pex6
cgacaacaacggagg

SEQ ID NO: 82819 - DNA, 15 bp, Artificial Sequence
  dgRNA
  Pex6
ggcggtcgtcaagcc

SEQ ID NO: 82820 - DNA, 15 bp, Artificial Sequence
  dgRNA
  Defb3
gtcgaaatctaccca

SEQ ID NO: 82821 - DNA, 15 bp, Artificial Sequence
  dgRNA
  Defb3
tcgaaatctacccag

SEQ ID NO: 82822 - DNA, 15 bp, Artificial Sequence
  dgRNA
  Trak1
tctacgctacagttt

SEQ ID NO: 82823 - DNA, 15 bp, Artificial Sequence
  dgRNA
  Trak1
cgccccaccctagag

SEQ ID NO: 82824 - DNA, 15 bp, Artificial Sequence
  dgRNA
  Trak1
agaggtgtcgtgttg

SEQ ID NO: 82825 - DNA, 15 bp, Artificial Sequence
  dgRNA
  Trak1
aggtgatagggctcc

SEQ ID NO: 82826 - DNA, 15 bp, Artificial Sequence
  dgRNA
  Pot1a
aatccgcgtgagcca

SEQ ID NO: 82827 - DNA, 15 bp, Artificial Sequence
  dgRNA
  Pot1a
gcgtgagccaaggag

SEQ ID NO: 82828 - DNA, 15 bp, Artificial Sequence
  dgRNA
  Pot1a
tgagccaaggagcgg

SEQ ID NO: 82829 - DNA, 15 bp, Artificial Sequence
  dgRNA
  Pot1a
ttacccgggagttcc

SEQ ID NO: 82830 - DNA, 15 bp, Artificial Sequence
  dgRNA
  Phf13
cccgctctgaagctc

SEQ ID NO: 82831 - DNA, 15 bp, Artificial Sequence
  dgRNA
  Phf13
atagtctctagacgc

SEQ ID NO: 82832 - DNA, 15 bp, Artificial Sequence
  dgRNA
  Phf13
tagtctctagacgcc

SEQ ID NO: 82833 - DNA, 15 bp, Artificial Sequence
  dgRNA
  Phf13
agtctctagacgccg

SEQ ID NO: 82834 - DNA, 15 bp, Artificial Sequence
  dgRNA
  Pnldc1
cccaccagccggctc

SEQ ID NO: 82835 - DNA, 15 bp, Artificial Sequence
  dgRNA
  Pnldc1
ttgatcttctcatgc

SEQ ID NO: 82836 - DNA, 15 bp, Artificial Sequence
  dgRNA
  Pnldc1
ccagagccggctggt

SEQ ID NO: 82837 - DNA, 15 bp, Artificial Sequence
  dgRNA
  Ptchd3
agctttggtaagtac

SEQ ID NO: 82838 - DNA, 15 bp, Artificial Sequence
  dgRNA
  Ptchd3
gctttggtaagtaca

SEQ ID NO: 82839 - DNA, 15 bp, Artificial Sequence
  dgRNA
  Ptchd3
gagggaatgcgccat

SEQ ID NO: 82840 - DNA, 15 bp, Artificial Sequence
  dgRNA
  Ptchd3
ggaatgcgccatagg

SEQ ID NO: 82841 - DNA, 15 bp, Artificial Sequence
  dgRNA
  Slc7a9
gcttcctccacgcct

SEQ ID NO: 82842 - DNA, 15 bp, Artificial Sequence
  dgRNA
  Slc7a9
ttggccctacaattg

SEQ ID NO: 82843 - DNA, 15 bp, Artificial Sequence
  dgRNA
  Slc7a9
tggccctacaattgc

SEQ ID NO: 82844 - DNA, 15 bp, Artificial Sequence
  dgRNA
  Slc7a9
cctacaattgcgggc

SEQ ID NO: 82845 - DNA, 15 bp, Artificial Sequence
  dgRNA
  Coasy
gccgagagactcctg

SEQ ID NO: 82846 - DNA, 15 bp, Artificial Sequence
  dgRNA
  Coasy
cgccgagagactcct

SEQ ID NO: 82847 - DNA, 15 bp, Artificial Sequence
  dgRNA
  Coasy
tcgccgagagactcc

SEQ ID NO: 82848 - DNA, 15 bp, Artificial Sequence
  dgRNA
  Tmem176b
ctcacacagaggcgc

SEQ ID NO: 82849 - DNA, 15 bp, Artificial Sequence
  dgRNA
  Tmem176b
actgagggccccttt

SEQ ID NO: 82850 - DNA, 15 bp, Artificial Sequence
  dgRNA
  Tmem176b
ctgagggccccttta

SEQ ID NO: 82851 - DNA, 15 bp, Artificial Sequence
  dgRNA
  Tmem176b
tgagggcccctttag

SEQ ID NO: 82852 - DNA, 15 bp, Artificial Sequence
  dgRNA
  Dcun1d3
gcggccgccgccggt

SEQ ID NO: 82853 - DNA, 15 bp, Artificial Sequence
  dgRNA
  Dcun1d3
ccgcggtggcagaaa

SEQ ID NO: 82854 - DNA, 15 bp, Artificial Sequence
  dgRNA
  Dcun1d3
tggcagaaaaggcgg

SEQ ID NO: 82855 - DNA, 15 bp, Artificial Sequence
  dgRNA
  Dcun1d3
cagaaaaggcggcgg

SEQ ID NO: 82856 - DNA, 15 bp, Artificial Sequence
  dgRNA
  Stxbp2
aatttctggacaggg

SEQ ID NO: 82857 - DNA, 15 bp, Artificial Sequence
  dgRNA
  Stxbp2
ggtggtatttgtact

SEQ ID NO: 82858 - DNA, 15 bp, Artificial Sequence
  dgRNA
  Stxbp2
tatttaagactcccg

SEQ ID NO: 82859 - DNA, 15 bp, Artificial Sequence
  dgRNA
  Stxbp2
atttaagactcccga

SEQ ID NO: 82860 - DNA, 15 bp, Artificial Sequence
  dgRNA
  Elk4
gactttgggcctgcg

SEQ ID NO: 82861 - DNA, 15 bp, Artificial Sequence
  dgRNA
  Elk4
ggaagtacgaatgtc

SEQ ID NO: 82862 - DNA, 15 bp, Artificial Sequence
  dgRNA
  Elk4
cccggagcgagtgca

SEQ ID NO: 82863 - DNA, 15 bp, Artificial Sequence
  dgRNA
  Elk4
ccggagcgagtgcac

SEQ ID NO: 82864 - DNA, 15 bp, Artificial Sequence
  dgRNA
  Commd6
taagtcaggctaagc

SEQ ID NO: 82865 - DNA, 15 bp, Artificial Sequence
  dgRNA
  Commd6
ctaagccggtgaact

SEQ ID NO: 82866 - DNA, 15 bp, Artificial Sequence
  dgRNA
  Commd6
ggtgaactcggtccc

SEQ ID NO: 82867 - DNA, 15 bp, Artificial Sequence
  dgRNA
  Commd6
gtgaactcggtccca

SEQ ID NO: 82868 - DNA, 15 bp, Artificial Sequence
  dgRNA
  Tef
gcattcggttcatgt

SEQ ID NO: 82869 - DNA, 15 bp, Artificial Sequence
  dgRNA
  Tef
tgcattcggttcatg

SEQ ID NO: 82870 - DNA, 15 bp, Artificial Sequence
  dgRNA
  Tef
atagcaccatgcatt

SEQ ID NO: 82871 - DNA, 15 bp, Artificial Sequence
  dgRNA
  Tef
ggtgcaaatcaacct

SEQ ID NO: 82872 - DNA, 15 bp, Artificial Sequence
  dgRNA
  Mcur1
ggcgtggggatgtaa

SEQ ID NO: 82873 - DNA, 15 bp, Artificial Sequence
  dgRNA
  Mcur1
atgtaaaggcggacc

SEQ ID NO: 82874 - DNA, 15 bp, Artificial Sequence
  dgRNA
  Mcur1
aggcggacccggcag

SEQ ID NO: 82875 - DNA, 15 bp, Artificial Sequence
  dgRNA
  Mcur1
ggcggacccggcaga

SEQ ID NO: 82876 - DNA, 15 bp, Artificial Sequence
  dgRNA
  Tctn3
gctgccatctagcgg

SEQ ID NO: 82877 - DNA, 15 bp, Artificial Sequence
  dgRNA
  Tctn3
ctgccatctagcggc

SEQ ID NO: 82878 - DNA, 15 bp, Artificial Sequence
  dgRNA
  Tctn3
tctagcggcgggatc

SEQ ID NO: 82879 - DNA, 15 bp, Artificial Sequence
  dgRNA
  Tctn3
acgccttcgcccccg

SEQ ID NO: 82880 - DNA, 15 bp, Artificial Sequence
  dgRNA
  Tdrd1
taggcgtcagctgag

SEQ ID NO: 82881 - DNA, 15 bp, Artificial Sequence
  dgRNA
  Tdrd1
attgagaaggcggtt

SEQ ID NO: 82882 - DNA, 15 bp, Artificial Sequence
  dgRNA
  Tdrd1
agaaggcggtttgga

SEQ ID NO: 82883 - DNA, 15 bp, Artificial Sequence
  dgRNA
  Tdrd1
gcggtttggatggtc

SEQ ID NO: 82884 - DNA, 15 bp, Artificial Sequence
  dgRNA
  Zfp2
cccgcgcgcccagtg

SEQ ID NO: 82885 - DNA, 15 bp, Artificial Sequence
  dgRNA
  Zfp2
ccgcactgggcgcgc

SEQ ID NO: 82886 - DNA, 15 bp, Artificial Sequence
  dgRNA
  Zfp2
gccgcactgggcgcg

SEQ ID NO: 82887 - DNA, 15 bp, Artificial Sequence
  dgRNA
  Yipf7
tgtccaccgtgtcag

SEQ ID NO: 82888 - DNA, 15 bp, Artificial Sequence
  dgRNA
  Yipf7
atgcccactaaactg

SEQ ID NO: 82889 - DNA, 15 bp, Artificial Sequence
  dgRNA
  Yipf7
atgaatatggtaatc

SEQ ID NO: 82890 - DNA, 15 bp, Artificial Sequence
  dgRNA
  Faxc
gctgcggccgagcag

SEQ ID NO: 82891 - DNA, 15 bp, Artificial Sequence
  dgRNA
  Faxc
agaggcagcgcaccg

SEQ ID NO: 82892 - DNA, 15 bp, Artificial Sequence
  dgRNA
  Faxc
gaggcagcgcaccgc

SEQ ID NO: 82893 - DNA, 15 bp, Artificial Sequence
  dgRNA
  Faxc
aggcagcgcaccgcg

SEQ ID NO: 82894 - DNA, 15 bp, Artificial Sequence
  dgRNA
  Vmn1r24
gtaggaatcacttgc

SEQ ID NO: 82895 - DNA, 15 bp, Artificial Sequence
  dgRNA
  Vmn1r24
taggaatcacttgca

SEQ ID NO: 82896 - DNA, 15 bp, Artificial Sequence
  dgRNA
  Xbp1
ccgctaaccctaagc

SEQ ID NO: 82897 - DNA, 15 bp, Artificial Sequence
  dgRNA
  Xbp1
cgggggacgtagcgc

SEQ ID NO: 82898 - DNA, 15 bp, Artificial Sequence
  dgRNA
  Xbp1
cgccggacattaaaa

SEQ ID NO: 82899 - DNA, 15 bp, Artificial Sequence
  dgRNA
  Xbp1
gccggacattaaaat

SEQ ID NO: 82900 - DNA, 15 bp, Artificial Sequence
  dgRNA
  Pfas
agccccaacccaccg

SEQ ID NO: 82901 - DNA, 15 bp, Artificial Sequence
  dgRNA
  Pfas
gccccaacccaccgc

SEQ ID NO: 82902 - DNA, 15 bp, Artificial Sequence
  dgRNA
  Pfas
ccccaacccaccgcg

SEQ ID NO: 82903 - DNA, 15 bp, Artificial Sequence
  dgRNA
  Pfas
caccgcggggagcct

SEQ ID NO: 82904 - DNA, 15 bp, Artificial Sequence
  dgRNA
  Birc7
aggggatgccattgg

SEQ ID NO: 82905 - DNA, 15 bp, Artificial Sequence
  dgRNA
  Birc7
ggggatgccattgga

SEQ ID NO: 82906 - DNA, 15 bp, Artificial Sequence
  dgRNA
  Birc7
gaggggtcccaagct

SEQ ID NO: 82907 - DNA, 15 bp, Artificial Sequence
  dgRNA
  Birc7
ctctcaataggggga

SEQ ID NO: 82908 - DNA, 15 bp, Artificial Sequence
  dgRNA
  Mfhas1
tttgaggaccgcatc

SEQ ID NO: 82909 - DNA, 15 bp, Artificial Sequence
  dgRNA
  Mfhas1
cgcatctggtgcgcc

SEQ ID NO: 82910 - DNA, 15 bp, Artificial Sequence
  dgRNA
  Mfhas1
tggtgcgcctggcgc

SEQ ID NO: 82911 - DNA, 15 bp, Artificial Sequence
  dgRNA
  Mfhas1
ggtgcgcctggcgca

SEQ ID NO: 82912 - DNA, 15 bp, Artificial Sequence
  dgRNA
  Myo5a
ccttcgcgcacactg

SEQ ID NO: 82913 - DNA, 15 bp, Artificial Sequence
  dgRNA
  Myo5a
cttcgcgcacactgt

SEQ ID NO: 82914 - DNA, 15 bp, Artificial Sequence
  dgRNA
  Myo5a
ttcgcgcacactgtg

SEQ ID NO: 82915 - DNA, 15 bp, Artificial Sequence
  dgRNA
  Myo5a
tcgcgcacactgtgg

SEQ ID NO: 82916 - DNA, 15 bp, Artificial Sequence
  dgRNA
  Gm5617
gtcaccttcgtctcc

SEQ ID NO: 82917 - DNA, 15 bp, Artificial Sequence
  dgRNA
  Gm5617
cgctgttccagtccc

SEQ ID NO: 82918 - DNA, 15 bp, Artificial Sequence
  dgRNA
  Gm5617
gcgggcacggtccta

SEQ ID NO: 82919 - DNA, 15 bp, Artificial Sequence
  dgRNA
  Gm5617
ggcgggcacggtcct

SEQ ID NO: 82920 - DNA, 15 bp, Artificial Sequence
  dgRNA
  B4galnt3
aggagcccggctccg

SEQ ID NO: 82921 - DNA, 15 bp, Artificial Sequence
  dgRNA
  B4galnt3
gcccggctccgcggc

SEQ ID NO: 82922 - DNA, 15 bp, Artificial Sequence
  dgRNA
  B4galnt3
ggagaacgacctgcg

SEQ ID NO: 82923 - DNA, 15 bp, Artificial Sequence
  dgRNA
  B4galnt3
gcacccgcgcagccc

SEQ ID NO: 82924 - DNA, 15 bp, Artificial Sequence
  dgRNA
  Topaz1
cgcttcctgtagtgt

SEQ ID NO: 82925 - DNA, 15 bp, Artificial Sequence
  dgRNA
  Topaz1
tgtagtgtcgggtac

SEQ ID NO: 82926 - DNA, 15 bp, Artificial Sequence
  dgRNA
  Topaz1
gtagtgtcgggtaca

SEQ ID NO: 82927 - DNA, 15 bp, Artificial Sequence
  dgRNA
  Topaz1
tgtcgggtacagggt

SEQ ID NO: 82928 - DNA, 15 bp, Artificial Sequence
  dgRNA
  Ppp2r2d
tgacacgactcgaga

SEQ ID NO: 82929 - DNA, 15 bp, Artificial Sequence
  dgRNA
  Ppp2r2d
ctccttggaccgcag

SEQ ID NO: 82930 - DNA, 15 bp, Artificial Sequence
  dgRNA
  Ppp2r2d
ccgcagcggctacgt

SEQ ID NO: 82931 - DNA, 15 bp, Artificial Sequence
  dgRNA
  Ppp2r2d
tcgcgcagacgcagt

SEQ ID NO: 82932 - DNA, 15 bp, Artificial Sequence
  dgRNA
  Olfr66
agacatgctaccatg

SEQ ID NO: 82933 - DNA, 15 bp, Artificial Sequence
  dgRNA
  Olfr66
catgctaccatgagg

SEQ ID NO: 82934 - DNA, 15 bp, Artificial Sequence
  dgRNA
  Olfr66
caatcaccatgagtc

SEQ ID NO: 82935 - DNA, 15 bp, Artificial Sequence
  dgRNA
  Olfr66
tggtagcatgtcttc

SEQ ID NO: 82936 - DNA, 15 bp, Artificial Sequence
  dgRNA
  Bcl6
aagacgccgacgtca

SEQ ID NO: 82937 - DNA, 15 bp, Artificial Sequence
  dgRNA
  Bcl6
acggagcccacgtga

SEQ ID NO: 82938 - DNA, 15 bp, Artificial Sequence
  dgRNA
  Bcl6
cccacgtgacggcgg

SEQ ID NO: 82939 - DNA, 15 bp, Artificial Sequence
  dgRNA
  Bcl6
gtgacggcggcggag

SEQ ID NO: 82940 - DNA, 15 bp, Artificial Sequence
  dgRNA
  Tspan4
tcgggaggggtctcc

SEQ ID NO: 82941 - DNA, 15 bp, Artificial Sequence
  dgRNA
  Tspan4
cgggaggggtctcct

SEQ ID NO: 82942 - DNA, 15 bp, Artificial Sequence
  dgRNA
  Tspan4
gctggtcggagccac

SEQ ID NO: 82943 - DNA, 15 bp, Artificial Sequence
  dgRNA
  Tspan4
cccccgatgtcaccc

SEQ ID NO: 82944 - DNA, 15 bp, Artificial Sequence
  dgRNA
  Mitd1
cacgaccgcactcac

SEQ ID NO: 82945 - DNA, 15 bp, Artificial Sequence
  dgRNA
  Mitd1
cgcagccggaaggag

SEQ ID NO: 82946 - DNA, 15 bp, Artificial Sequence
  dgRNA
  Mitd1
ccgtcacagaccgta

SEQ ID NO: 82947 - DNA, 15 bp, Artificial Sequence
  dgRNA
  Mitd1
gaccgtacggttctt

SEQ ID NO: 82948 - DNA, 15 bp, Artificial Sequence
  dgRNA
  Gypa
gccaatgtgtgtcaa

SEQ ID NO: 82949 - DNA, 15 bp, Artificial Sequence
  dgRNA
  Gypa
tgtgtcaacggatag

SEQ ID NO: 82950 - DNA, 15 bp, Artificial Sequence
  dgRNA
  Gypa
aacggatagaggccc

SEQ ID NO: 82951 - DNA, 15 bp, Artificial Sequence
  dgRNA
  Gypa
acggatagaggcccc

SEQ ID NO: 82952 - DNA, 15 bp, Artificial Sequence
  dgRNA
  Pafah1b1
cccaccaatttactt

SEQ ID NO: 82953 - DNA, 15 bp, Artificial Sequence
  dgRNA
  Pafah1b1
taatcccacaggcta

SEQ ID NO: 82954 - DNA, 15 bp, Artificial Sequence
  dgRNA
  Pafah1b1
tgcaccgggtacccg

SEQ ID NO: 82955 - DNA, 15 bp, Artificial Sequence
  dgRNA
  Pafah1b1
taaattggtgggctt

SEQ ID NO: 82956 - DNA, 15 bp, Artificial Sequence
  dgRNA
  Top2a
cttcttttacctaat

SEQ ID NO: 82957 - DNA, 15 bp, Artificial Sequence
  dgRNA
  Top2a
ttggtttattcgaaa

SEQ ID NO: 82958 - DNA, 15 bp, Artificial Sequence
  dgRNA
  Top2a
gtttattcgaaaagg

SEQ ID NO: 82959 - DNA, 15 bp, Artificial Sequence
  dgRNA
  Top2a
aagacgatctacgat

SEQ ID NO: 82960 - DNA, 15 bp, Artificial Sequence
  dgRNA
  Klhdc7a
gccaagggcccagtc

SEQ ID NO: 82961 - DNA, 15 bp, Artificial Sequence
  dgRNA
  Klhdc7a
ctgacccctcagtta

SEQ ID NO: 82962 - DNA, 15 bp, Artificial Sequence
  dgRNA
  Klhdc7a
tacgcctgttaactg

SEQ ID NO: 82963 - DNA, 15 bp, Artificial Sequence
  dgRNA
  Klhdc7a
ctgctccgggaacca

SEQ ID NO: 82964 - DNA, 15 bp, Artificial Sequence
  dgRNA
  Nlrp3
tttaatggaaagccc

SEQ ID NO: 82965 - DNA, 15 bp, Artificial Sequence
  dgRNA
  Nlrp3
cccgatttcttttaa

SEQ ID NO: 82966 - DNA, 15 bp, Artificial Sequence
  dgRNA
  Eng
ccggcccagagaggc

SEQ ID NO: 82967 - DNA, 15 bp, Artificial Sequence
  dgRNA
  Rbp3
cgggtcaaaccaccc

SEQ ID NO: 82968 - DNA, 15 bp, Artificial Sequence
  dgRNA
  Rbp3
gtgcttgaattagac

SEQ ID NO: 82969 - DNA, 15 bp, Artificial Sequence
  dgRNA
  Rbp3
attagacaggattaa

SEQ ID NO: 82970 - DNA, 15 bp, Artificial Sequence
  dgRNA
  Rbp3
gtggtttgacccgga

SEQ ID NO: 82971 - DNA, 15 bp, Artificial Sequence
  dgRNA
  Itga7
agggcgcaaggcaat

SEQ ID NO: 82972 - DNA, 15 bp, Artificial Sequence
  dgRNA
  Itga7
aggcaatgggtgcgg

SEQ ID NO: 82973 - DNA, 15 bp, Artificial Sequence
  dgRNA
  Itga7
ggcaatgggtgcggc

SEQ ID NO: 82974 - DNA, 15 bp, Artificial Sequence
  dgRNA
  Itga7
gctagacctgagccg

SEQ ID NO: 82975 - DNA, 15 bp, Artificial Sequence
  dgRNA
  Hnrnpr
ccggaactgcttcca

SEQ ID NO: 82976 - DNA, 15 bp, Artificial Sequence
  dgRNA
  Hnrnpr
cccggaactgcttcc

SEQ ID NO: 82977 - DNA, 15 bp, Artificial Sequence
  dgRNA
  Hnrnpr
gcacgcggggtttcc

SEQ ID NO: 82978 - DNA, 15 bp, Artificial Sequence
  dgRNA
  6330409D20Rik
ctggagggaaccggc

SEQ ID NO: 82979 - DNA, 15 bp, Artificial Sequence
  dgRNA
  6330409D20Rik
tggagggaaccggca

SEQ ID NO: 82980 - DNA, 15 bp, Artificial Sequence
  dgRNA
  6330409D20Rik
taacccaatcctttg

SEQ ID NO: 82981 - DNA, 15 bp, Artificial Sequence
  dgRNA
  6330409D20Rik
ctaattgagaatagc

SEQ ID NO: 82982 - DNA, 15 bp, Artificial Sequence
  dgRNA
  Nrarp
cagcgccctctatcc

SEQ ID NO: 82983 - DNA, 15 bp, Artificial Sequence
  dgRNA
  Nrarp
cgccctctatcctgg

SEQ ID NO: 82984 - DNA, 15 bp, Artificial Sequence
  dgRNA
  Nrarp
gccctctatcctgga

SEQ ID NO: 82985 - DNA, 15 bp, Artificial Sequence
  dgRNA
  Nrarp
caatcgaaagagccc

SEQ ID NO: 82986 - DNA, 15 bp, Artificial Sequence
  dgRNA
  Crip2
gaaacgaggcaacaa

SEQ ID NO: 82987 - DNA, 15 bp, Artificial Sequence
  dgRNA
  Crip2
aaacgaggcaacaaa

SEQ ID NO: 82988 - DNA, 15 bp, Artificial Sequence
  dgRNA
  Crip2
cgaggcaacaaaggg

SEQ ID NO: 82989 - DNA, 15 bp, Artificial Sequence
  dgRNA
  Crip2
aagggaggcggcgcc

SEQ ID NO: 82990 - DNA, 15 bp, Artificial Sequence
  dgRNA
  Zfp92
tgtagtggcgacatc

SEQ ID NO: 82991 - DNA, 15 bp, Artificial Sequence
  dgRNA
  Zfp92
gtagtggcgacatct

SEQ ID NO: 82992 - DNA, 15 bp, Artificial Sequence
  dgRNA
  Zfp92
tagtggcgacatctg

SEQ ID NO: 82993 - DNA, 15 bp, Artificial Sequence
  dgRNA
  Zfp92
ttcaacactgtcccg

SEQ ID NO: 82994 - DNA, 15 bp, Artificial Sequence
  dgRNA
  Clec4a2
aatagtgttaaccca

SEQ ID NO: 82995 - DNA, 15 bp, Artificial Sequence
  dgRNA
  Clec4a2
catggaagtagctag

SEQ ID NO: 82996 - DNA, 15 bp, Artificial Sequence
  dgRNA
  Rpl22l1
gaacttactccactc

SEQ ID NO: 82997 - DNA, 15 bp, Artificial Sequence
  dgRNA
  Rpl22l1
agaatcagtcggctc

SEQ ID NO: 82998 - DNA, 15 bp, Artificial Sequence
  dgRNA
  Rpl22l1
cccactcgaagacgc

SEQ ID NO: 82999 - DNA, 15 bp, Artificial Sequence
  dgRNA
  Rpl22l1
actcgaagacgcagg

SEQ ID NO: 83000 - DNA, 15 bp, Artificial Sequence
  dgRNA
  Dao
ctcattccggctttt

SEQ ID NO: 83001 - DNA, 15 bp, Artificial Sequence
  dgRNA
  Dao
agcgcacgtgacagt

SEQ ID NO: 83002 - DNA, 15 bp, Artificial Sequence
  dgRNA
  Dao
gcacgtgacagtcgg

SEQ ID NO: 83003 - DNA, 15 bp, Artificial Sequence
  dgRNA
  Dao
gacagtcggaggcgc

SEQ ID NO: 83004 - DNA, 15 bp, Artificial Sequence
  dgRNA
  P3h1
tcctagagggaaccg

SEQ ID NO: 83005 - DNA, 15 bp, Artificial Sequence
  dgRNA
  P3h1
tagagggaaccgagg

SEQ ID NO: 83006 - DNA, 15 bp, Artificial Sequence
  dgRNA
  P3h1
ccgaggcggccgcta

SEQ ID NO: 83007 - DNA, 15 bp, Artificial Sequence
  dgRNA
  P3h1
cagcagcgctctttc

SEQ ID NO: 83008 - DNA, 15 bp, Artificial Sequence
  dgRNA
  Cebpe
atcccttgaactcgc

SEQ ID NO: 83009 - DNA, 15 bp, Artificial Sequence
  dgRNA
  Cebpe
tcccttgaactcgca

SEQ ID NO: 83010 - DNA, 15 bp, Artificial Sequence
  dgRNA
  Cebpe
actcgcagggcaaaa

SEQ ID NO: 83011 - DNA, 15 bp, Artificial Sequence
  dgRNA
  Cebpe
ctcgcagggcaaaaa

SEQ ID NO: 83012 - DNA, 15 bp, Artificial Sequence
  dgRNA
  Ppp2r3d
tgcagcacgtaagag

SEQ ID NO: 83013 - DNA, 15 bp, Artificial Sequence
  dgRNA
  Ppp2r3d
atagtcagagtgggc

SEQ ID NO: 83014 - DNA, 15 bp, Artificial Sequence
  dgRNA
  Ppp2r3d
ggccatagtcagagt

SEQ ID NO: 83015 - DNA, 15 bp, Artificial Sequence
  dgRNA
  Ppp2r3d
gggccatagtcagag

SEQ ID NO: 83016 - DNA, 15 bp, Artificial Sequence
  dgRNA
  Rnf220
ctccgaagggaaagg

SEQ ID NO: 83017 - DNA, 15 bp, Artificial Sequence
  dgRNA
  Rnf220
ccagccctctagtga

SEQ ID NO: 83018 - DNA, 15 bp, Artificial Sequence
  dgRNA
  Rnf220
ctctcccggagtgcc

SEQ ID NO: 83019 - DNA, 15 bp, Artificial Sequence
  dgRNA
  Rnf220
tctcccggagtgccc

SEQ ID NO: 83020 - DNA, 15 bp, Artificial Sequence
  dgRNA
  Zswim7
cccgcggcccgcagc

SEQ ID NO: 83021 - DNA, 15 bp, Artificial Sequence
  dgRNA
  Zswim7
ccgcggcccgcagca

SEQ ID NO: 83022 - DNA, 15 bp, Artificial Sequence
  dgRNA
  Zswim7
cgccagcgaagcaac

SEQ ID NO: 83023 - DNA, 15 bp, Artificial Sequence
  dgRNA
  Zswim7
accggaacatgccga

SEQ ID NO: 83024 - DNA, 15 bp, Artificial Sequence
  dgRNA
  Ppp1r7
acactcgccgccacc

SEQ ID NO: 83025 - DNA, 15 bp, Artificial Sequence
  dgRNA
  Ppp1r7
ctcgccgccacccgg

SEQ ID NO: 83026 - DNA, 15 bp, Artificial Sequence
  dgRNA
  Ppp1r7
ccggaggtttttcga

SEQ ID NO: 83027 - DNA, 15 bp, Artificial Sequence
  dgRNA
  Ppp1r7
aggtttttcgaaggc

SEQ ID NO: 83028 - DNA, 15 bp, Artificial Sequence
  dgRNA
  Kcne1l
cgcagcccagggtcc

SEQ ID NO: 83029 - DNA, 15 bp, Artificial Sequence
  dgRNA
  Kcne1l
gcaaggctgcatact

SEQ ID NO: 83030 - DNA, 15 bp, Artificial Sequence
  dgRNA
  Kcne1l
ggcaaggctgcatac

SEQ ID NO: 83031 - DNA, 15 bp, Artificial Sequence
  dgRNA
  Kcne1l
aatgcgcgaggcccc

SEQ ID NO: 83032 - DNA, 15 bp, Artificial Sequence
  dgRNA
  Fthl17a
atcactacattgata

SEQ ID NO: 83033 - DNA, 15 bp, Artificial Sequence
  dgRNA
  Vmn2r25
tactccagcgaacag

SEQ ID NO: 83034 - DNA, 15 bp, Artificial Sequence
  dgRNA
  Vmn2r25
actccagcgaacaga

SEQ ID NO: 83035 - DNA, 15 bp, Artificial Sequence
  dgRNA
  Vmn2r25
actccctctgttcgc

SEQ ID NO: 83036 - DNA, 15 bp, Artificial Sequence
  dgRNA
  Vmn2r25
ttcagttgaggatct

SEQ ID NO: 83037 - DNA, 15 bp, Artificial Sequence
  dgRNA
  C1ql4
ggttctgaaccctca

SEQ ID NO: 83038 - DNA, 15 bp, Artificial Sequence
  dgRNA
  C1ql4
gttctgaaccctcaa

SEQ ID NO: 83039 - DNA, 15 bp, Artificial Sequence
  dgRNA
  C1ql4
ttggcccagctcacg

SEQ ID NO: 83040 - DNA, 15 bp, Artificial Sequence
  dgRNA
  C1ql4
gatcgccaccctgac

SEQ ID NO: 83041 - DNA, 15 bp, Artificial Sequence
  dgRNA
  Cenpj
ccctagcaacgttta

SEQ ID NO: 83042 - DNA, 15 bp, Artificial Sequence
  dgRNA
  Cenpj
tagcaacgtttatgg

SEQ ID NO: 83043 - DNA, 15 bp, Artificial Sequence
  dgRNA
  Cenpj
ttatggcggtgttgc

SEQ ID NO: 83044 - DNA, 15 bp, Artificial Sequence
  dgRNA
  Cenpj
tatggcggtgttgct

SEQ ID NO: 83045 - DNA, 15 bp, Artificial Sequence
  dgRNA
  Aspm
accatcgtttaaaca

SEQ ID NO: 83046 - DNA, 15 bp, Artificial Sequence
  dgRNA
  Aspm
gcgccgcttcctcat

SEQ ID NO: 83047 - DNA, 15 bp, Artificial Sequence
  dgRNA
  Aspm
ctttcgttcgctcat

SEQ ID NO: 83048 - DNA, 15 bp, Artificial Sequence
  dgRNA
  Aspm
tttagtgatgtgggc

SEQ ID NO: 83049 - DNA, 15 bp, Artificial Sequence
  dgRNA
  Eif1b
caagtccagaccccc

SEQ ID NO: 83050 - DNA, 15 bp, Artificial Sequence
  dgRNA
  Eif1b
aagtccagacccccg

SEQ ID NO: 83051 - DNA, 15 bp, Artificial Sequence
  dgRNA
  Eif1b
agtccagacccccgg

SEQ ID NO: 83052 - DNA, 15 bp, Artificial Sequence
  dgRNA
  Eif1b
tctcgccgttgcacc

SEQ ID NO: 83053 - DNA, 15 bp, Artificial Sequence
  dgRNA
  Zbtb44
cccgcacgcgcgctg

SEQ ID NO: 83054 - DNA, 15 bp, Artificial Sequence
  dgRNA
  Zbtb44
gcacgcgcgctgcgg

SEQ ID NO: 83055 - DNA, 15 bp, Artificial Sequence
  dgRNA
  Zbtb44
gcgcgagcgagcctt

SEQ ID NO: 83056 - DNA, 15 bp, Artificial Sequence
  dgRNA
  Zbtb44
accaaccgcccccaa

SEQ ID NO: 83057 - DNA, 15 bp, Artificial Sequence
  dgRNA
  Aldh5a1
atccgacattgagaa

SEQ ID NO: 83058 - DNA, 15 bp, Artificial Sequence
  dgRNA
  Aldh5a1
acgaattcatcttgc

SEQ ID NO: 83059 - DNA, 15 bp, Artificial Sequence
  dgRNA
  Aldh5a1
cgaattcatcttgct

SEQ ID NO: 83060 - DNA, 15 bp, Artificial Sequence
  dgRNA
  Aldh5a1
agtctttccattcgc

SEQ ID NO: 83061 - DNA, 15 bp, Artificial Sequence
  dgRNA
  Gpr137c
ccgagccgcggcccg

SEQ ID NO: 83062 - DNA, 15 bp, Artificial Sequence
  dgRNA
  Gpr137c
ggaaccgagcccccc

SEQ ID NO: 83063 - DNA, 15 bp, Artificial Sequence
  dgRNA
  Gpr137c
gaaccgagccccccg

SEQ ID NO: 83064 - DNA, 15 bp, Artificial Sequence
  dgRNA
  Gpr137c
aaccgagccccccgg

SEQ ID NO: 83065 - DNA, 15 bp, Artificial Sequence
  dgRNA
  Ddx59
actttctaagcgtgg

SEQ ID NO: 83066 - DNA, 15 bp, Artificial Sequence
  dgRNA
  Ddx59
ctttctaagcgtgga

SEQ ID NO: 83067 - DNA, 15 bp, Artificial Sequence
  dgRNA
  Ddx59
cagcgcgtcaccgcg

SEQ ID NO: 83068 - DNA, 15 bp, Artificial Sequence
  dgRNA
  Ddx59
agcgcgtcaccgcga

SEQ ID NO: 83069 - DNA, 15 bp, Artificial Sequence
  dgRNA
  Ppfibp1
cggggcggtgggacg

SEQ ID NO: 83070 - DNA, 15 bp, Artificial Sequence
  dgRNA
  Ppfibp1
ggcggtgggacgagg

SEQ ID NO: 83071 - DNA, 15 bp, Artificial Sequence
  dgRNA
  Ppfibp1
gacgaggaggaccga

SEQ ID NO: 83072 - DNA, 15 bp, Artificial Sequence
  dgRNA
  Ppfibp1
acgaggaggaccgag

SEQ ID NO: 83073 - DNA, 15 bp, Artificial Sequence
  dgRNA
  Snai3
tgcgtgaccatgacg

SEQ ID NO: 83074 - DNA, 15 bp, Artificial Sequence
  dgRNA
  Snai3
gcgtgaccatgacgc

SEQ ID NO: 83075 - DNA, 15 bp, Artificial Sequence
  dgRNA
  Snai3
catgacgcgggccag

SEQ ID NO: 83076 - DNA, 15 bp, Artificial Sequence
  dgRNA
  Snai3
gccagcggagtcccg

SEQ ID NO: 83077 - DNA, 15 bp, Artificial Sequence
  dgRNA
  Dnajc30
gcggtccgctgtgtt

SEQ ID NO: 83078 - DNA, 15 bp, Artificial Sequence
  dgRNA
  Dnajc30
cggtccgctgtgttc

SEQ ID NO: 83079 - DNA, 15 bp, Artificial Sequence
  dgRNA
  Dnajc30
ctgtgttcgggtctc

SEQ ID NO: 83080 - DNA, 15 bp, Artificial Sequence
  dgRNA
  Dnajc30
gagatgccatctcga

SEQ ID NO: 83081 - DNA, 15 bp, Artificial Sequence
  dgRNA
  Maged2
aataggaaatgcgat

SEQ ID NO: 83082 - DNA, 15 bp, Artificial Sequence
  dgRNA
  Maged2
aatgcgatgggaaat

SEQ ID NO: 83083 - DNA, 15 bp, Artificial Sequence
  dgRNA
  Maged2
atgcgatgggaaata

SEQ ID NO: 83084 - DNA, 15 bp, Artificial Sequence
  dgRNA
  Maged2
agggagtccggagtt

SEQ ID NO: 83085 - DNA, 15 bp, Artificial Sequence
  dgRNA
  Dnase1l2
tgttgaggtggctag

SEQ ID NO: 83086 - DNA, 15 bp, Artificial Sequence
  dgRNA
  Dnase1l2
aatgggagccagttc

SEQ ID NO: 83087 - DNA, 15 bp, Artificial Sequence
  dgRNA
  Dnase1l2
tccaccccatggaag

SEQ ID NO: 83088 - DNA, 15 bp, Artificial Sequence
  dgRNA
  Dnase1l2
aacactataccgaaa

SEQ ID NO: 83089 - DNA, 15 bp, Artificial Sequence
  dgRNA
  C530008M17Rik
gttagcaagattttc

SEQ ID NO: 83090 - DNA, 15 bp, Artificial Sequence
  dgRNA
  C530008M17Rik
ccgagaaagagtgtt

SEQ ID NO: 83091 - DNA, 15 bp, Artificial Sequence
  dgRNA
  C530008M17Rik
ctagtacttatgaag

SEQ ID NO: 83092 - DNA, 15 bp, Artificial Sequence
  dgRNA
  C530008M17Rik
tgagcttctaactgg

SEQ ID NO: 83093 - DNA, 15 bp, Artificial Sequence
  dgRNA
  1700019A02Rik
ctcatggttgtagtt

SEQ ID NO: 83094 - DNA, 15 bp, Artificial Sequence
  dgRNA
  1700019A02Rik
gccaagttttgttac

SEQ ID NO: 83095 - DNA, 15 bp, Artificial Sequence
  dgRNA
  1700019A02Rik
gtcaaagtggcgtca

SEQ ID NO: 83096 - DNA, 15 bp, Artificial Sequence
  dgRNA
  1700019A02Rik
gccggtaacaaaact

SEQ ID NO: 83097 - DNA, 15 bp, Artificial Sequence
  dgRNA
  1700015G11Rik
aagtatagcagcttg

SEQ ID NO: 83098 - DNA, 15 bp, Artificial Sequence
  dgRNA
  1700015G11Rik
attgtgatggcaagg

SEQ ID NO: 83099 - DNA, 15 bp, Artificial Sequence
  dgRNA
  Krtap5-5
gtgtcaacagaccaa

SEQ ID NO: 83100 - DNA, 15 bp, Artificial Sequence
  dgRNA
  Krtap5-5
gccaaacaagtaaat

SEQ ID NO: 83101 - DNA, 15 bp, Artificial Sequence
  dgRNA
  Krtap5-5
atataaaggcccagc

SEQ ID NO: 83102 - DNA, 15 bp, Artificial Sequence
  dgRNA
  Krtap5-5
tgacgtaatttccta

SEQ ID NO: 83103 - DNA, 15 bp, Artificial Sequence
  dgRNA
  Ly6h
gctgcgccccggttc

SEQ ID NO: 83104 - DNA, 15 bp, Artificial Sequence
  dgRNA
  Ly6h
ccggttccggtccgc

SEQ ID NO: 83105 - DNA, 15 bp, Artificial Sequence
  dgRNA
  Ly6h
cggttccggtccgca

SEQ ID NO: 83106 - DNA, 15 bp, Artificial Sequence
  dgRNA
  Ly6h
ccgcagggagaccga

SEQ ID NO: 83107 - DNA, 15 bp, Artificial Sequence
  dgRNA
  Fam163b
cgtgagaaccccgca

SEQ ID NO: 83108 - DNA, 15 bp, Artificial Sequence
  dgRNA
  Fam163b
gcgcgcacaacagtg

SEQ ID NO: 83109 - DNA, 15 bp, Artificial Sequence
  dgRNA
  Fam163b
cgcgcacaacagtgt

SEQ ID NO: 83110 - DNA, 15 bp, Artificial Sequence
  dgRNA
  Fam163b
tgtgagctcagccgc

SEQ ID NO: 83111 - DNA, 15 bp, Artificial Sequence
  dgRNA
  Calr4
accgcaccctcccaa

SEQ ID NO: 83112 - DNA, 15 bp, Artificial Sequence
  dgRNA
  Calr4
ccaatggcagttttc

SEQ ID NO: 83113 - DNA, 15 bp, Artificial Sequence
  dgRNA
  Calr4
ccgcgaatgcagtgt

SEQ ID NO: 83114 - DNA, 15 bp, Artificial Sequence
  dgRNA
  Calr4
cgaatgcagtgttgg

SEQ ID NO: 83115 - DNA, 15 bp, Artificial Sequence
  dgRNA
  Tmem138
gtctctgggacccgc

SEQ ID NO: 83116 - DNA, 15 bp, Artificial Sequence
  dgRNA
  Tmem138
cggcatccgctacag

SEQ ID NO: 83117 - DNA, 15 bp, Artificial Sequence
  dgRNA
  Tmem138
ggcatccgctacaga

SEQ ID NO: 83118 - DNA, 15 bp, Artificial Sequence
  dgRNA
  Tmem138
aggctcggccacttc

SEQ ID NO: 83119 - DNA, 15 bp, Artificial Sequence
  dgRNA
  Vezt
cccatcgtgctgagg

SEQ ID NO: 83120 - DNA, 15 bp, Artificial Sequence
  dgRNA
  Vezt
ccatcgtgctgaggc

SEQ ID NO: 83121 - DNA, 15 bp, Artificial Sequence
  dgRNA
  Vezt
tcgtgctgaggcggg

SEQ ID NO: 83122 - DNA, 15 bp, Artificial Sequence
  dgRNA
  Vezt
ctgaggcgggtggta

SEQ ID NO: 83123 - DNA, 15 bp, Artificial Sequence
  dgRNA
  Klhl32
gagcgcgcgtgtcac

SEQ ID NO: 83124 - DNA, 15 bp, Artificial Sequence
  dgRNA
  Klhl32
tgtcacgggcgaacg

SEQ ID NO: 83125 - DNA, 15 bp, Artificial Sequence
  dgRNA
  Klhl32
cacgggcgaacgcgg

SEQ ID NO: 83126 - DNA, 15 bp, Artificial Sequence
  dgRNA
  Klhl32
acgggcgaacgcggc

SEQ ID NO: 83127 - DNA, 15 bp, Artificial Sequence
  dgRNA
  Des
gctgtccaggggcgc

SEQ ID NO: 83128 - DNA, 15 bp, Artificial Sequence
  dgRNA
  Des
ggcgcaggcctcttg

SEQ ID NO: 83129 - DNA, 15 bp, Artificial Sequence
  dgRNA
  Des
gcgcaggcctcttgc

SEQ ID NO: 83130 - DNA, 15 bp, Artificial Sequence
  dgRNA
  Des
cgcaggcctcttgcg

SEQ ID NO: 83131 - DNA, 15 bp, Artificial Sequence
  dgRNA
  Krt35
ggcttctgttttacg

SEQ ID NO: 83132 - DNA, 15 bp, Artificial Sequence
  dgRNA
  Krt35
ctgttttacgaggcc

SEQ ID NO: 83133 - DNA, 15 bp, Artificial Sequence
  dgRNA
  Krt35
gccgggctatgttca

SEQ ID NO: 83134 - DNA, 15 bp, Artificial Sequence
  dgRNA
  Krt35
ccgggctatgttcac

SEQ ID NO: 83135 - DNA, 15 bp, Artificial Sequence
  dgRNA
  Hhipl1
gtggaactgtgaaac

SEQ ID NO: 83136 - DNA, 15 bp, Artificial Sequence
  dgRNA
  Hhipl1
gtgaaactgggcaac

SEQ ID NO: 83137 - DNA, 15 bp, Artificial Sequence
  dgRNA
  Hhipl1
tgaaactgggcaacc

SEQ ID NO: 83138 - DNA, 15 bp, Artificial Sequence
  dgRNA
  Hhipl1
gaaactgggcaaccg

SEQ ID NO: 83139 - DNA, 15 bp, Artificial Sequence
  dgRNA
  Dcaf11
gtcacatgctcgccc

SEQ ID NO: 83140 - DNA, 15 bp, Artificial Sequence
  dgRNA
  Dcaf11
tcgccccgggagctg

SEQ ID NO: 83141 - DNA, 15 bp, Artificial Sequence
  dgRNA
  Dcaf11
gcgatggcccacctc

SEQ ID NO: 83142 - DNA, 15 bp, Artificial Sequence
  dgRNA
  Dcaf11
cgatggcccacctct

SEQ ID NO: 83143 - DNA, 15 bp, Artificial Sequence
  dgRNA
  Oxsm
ctaactctctaaagc

SEQ ID NO: 83144 - DNA, 15 bp, Artificial Sequence
  dgRNA
  Oxsm
ctacagacttcgggt

SEQ ID NO: 83145 - DNA, 15 bp, Artificial Sequence
  dgRNA
  Oxsm
gctgtacagttcatg

SEQ ID NO: 83146 - DNA, 15 bp, Artificial Sequence
  dgRNA
  Oxsm
cgacccgaagtctgt

SEQ ID NO: 83147 - DNA, 15 bp, Artificial Sequence
  dgRNA
  Capn5
aggcagccaacgtcc

SEQ ID NO: 83148 - DNA, 15 bp, Artificial Sequence
  dgRNA
  Capn5
ggcagccaacgtccc

SEQ ID NO: 83149 - DNA, 15 bp, Artificial Sequence
  dgRNA
  Capn5
gatgctctcctatcg

SEQ ID NO: 83150 - DNA, 15 bp, Artificial Sequence
  dgRNA
  Capn5
tatcgcggacagcac

SEQ ID NO: 83151 - DNA, 15 bp, Artificial Sequence
  dgRNA
  Mtrf1
aaaaggttcgcttct

SEQ ID NO: 83152 - DNA, 15 bp, Artificial Sequence
  dgRNA
  Mtrf1
ggagtaaagggtctt

SEQ ID NO: 83153 - DNA, 15 bp, Artificial Sequence
  dgRNA
  Mtrf1
gagtaaagggtctta

SEQ ID NO: 83154 - DNA, 15 bp, Artificial Sequence
  dgRNA
  Mtrf1
taaagggtcttaggg

SEQ ID NO: 83155 - DNA, 15 bp, Artificial Sequence
  dgRNA
  Slc6a19
tctcctgtccgtgaa

SEQ ID NO: 83156 - DNA, 15 bp, Artificial Sequence
  dgRNA
  Slc6a19
ctgtccgtgaatgga

SEQ ID NO: 83157 - DNA, 15 bp, Artificial Sequence
  dgRNA
  Slc6a19
tgtccgtgaatggag

SEQ ID NO: 83158 - DNA, 15 bp, Artificial Sequence
  dgRNA
  Slc6a19
gtccgtgaatggagg

SEQ ID NO: 83159 - DNA, 15 bp, Artificial Sequence
  dgRNA
  Rbbp8nl
ggcacccaggcggct

SEQ ID NO: 83160 - DNA, 15 bp, Artificial Sequence
  dgRNA
  Rbbp8nl
caggcggctcggatt

SEQ ID NO: 83161 - DNA, 15 bp, Artificial Sequence
  dgRNA
  Rbbp8nl
aggcggctcggatta

SEQ ID NO: 83162 - DNA, 15 bp, Artificial Sequence
  dgRNA
  Rbbp8nl
cttgcagctcccggc

SEQ ID NO: 83163 - DNA, 15 bp, Artificial Sequence
  dgRNA
  Ube2k
ctaggctgggacccg

SEQ ID NO: 83164 - DNA, 15 bp, Artificial Sequence
  dgRNA
  Wdr62
ggcaatgagcctacc

SEQ ID NO: 83165 - DNA, 15 bp, Artificial Sequence
  dgRNA
  Wdr62
cggaagctttgtgat

SEQ ID NO: 83166 - DNA, 15 bp, Artificial Sequence
  dgRNA
  Wdr62
ttgtgattggccagc

SEQ ID NO: 83167 - DNA, 15 bp, Artificial Sequence
  dgRNA
  Wdr62
ggccagccggggtgc

SEQ ID NO: 83168 - DNA, 15 bp, Artificial Sequence
  dgRNA
  Msantd3
gttgtttaagccgcc

SEQ ID NO: 83169 - DNA, 15 bp, Artificial Sequence
  dgRNA
  Msantd3
cgtcgcagcgcgcct

SEQ ID NO: 83170 - DNA, 15 bp, Artificial Sequence
  dgRNA
  Msantd3
gtcgcagcgcgcctt

SEQ ID NO: 83171 - DNA, 15 bp, Artificial Sequence
  dgRNA
  Msantd3
cgccttgggtcccac

SEQ ID NO: 83172 - DNA, 15 bp, Artificial Sequence
  dgRNA
  Col9a2
gtgttttaatatggc

SEQ ID NO: 83173 - DNA, 15 bp, Artificial Sequence
  dgRNA
  Col9a2
ggacctgattgtttg

SEQ ID NO: 83174 - DNA, 15 bp, Artificial Sequence
  dgRNA
  Col9a2
agacaagcttgcccg

SEQ ID NO: 83175 - DNA, 15 bp, Artificial Sequence
  dgRNA
  Col9a2
agcttgcccggggaa

SEQ ID NO: 83176 - DNA, 15 bp, Artificial Sequence
  dgRNA
  Fam135b
tcacaaccttgcctc

SEQ ID NO: 83177 - DNA, 15 bp, Artificial Sequence
  dgRNA
  Fam135b
tcgggcaccttagct

SEQ ID NO: 83178 - DNA, 15 bp, Artificial Sequence
  dgRNA
  Fam135b
cgggcaccttagctc

SEQ ID NO: 83179 - DNA, 15 bp, Artificial Sequence
  dgRNA
  Fam135b
ttagctcgggctgcc

SEQ ID NO: 83180 - DNA, 15 bp, Artificial Sequence
  dgRNA
  Cd8a
ttggaagggaccctt

SEQ ID NO: 83181 - DNA, 15 bp, Artificial Sequence
  dgRNA
  Oosp2
gtggagtaaataatc

SEQ ID NO: 83182 - DNA, 15 bp, Artificial Sequence
  dgRNA
  Oosp2
tggatcatgctctag

SEQ ID NO: 83183 - DNA, 15 bp, Artificial Sequence
  dgRNA
  Slc25a16
caagcctgaatttac

SEQ ID NO: 83184 - DNA, 15 bp, Artificial Sequence
  dgRNA
  Slc25a16
ctgaatttactggtc

SEQ ID NO: 83185 - DNA, 15 bp, Artificial Sequence
  dgRNA
  Slc25a16
ctggtctggctcaag

SEQ ID NO: 83186 - DNA, 15 bp, Artificial Sequence
  dgRNA
  Slc25a16
tcgcaaaccttcagc

SEQ ID NO: 83187 - DNA, 15 bp, Artificial Sequence
  dgRNA
  Dnajb12
gaacgcccctttctt

SEQ ID NO: 83188 - DNA, 15 bp, Artificial Sequence
  dgRNA
  Dnajb12
taggagacatacggt

SEQ ID NO: 83189 - DNA, 15 bp, Artificial Sequence
  dgRNA
  Dnajb12
aggagacatacggta

SEQ ID NO: 83190 - DNA, 15 bp, Artificial Sequence
  dgRNA
  Dnajb12
ggtagggcttccgcc

SEQ ID NO: 83191 - DNA, 15 bp, Artificial Sequence
  dgRNA
  Prss12
cggaaccaccgagaa

SEQ ID NO: 83192 - DNA, 15 bp, Artificial Sequence
  dgRNA
  Prss12
ggaaccaccgagaac

SEQ ID NO: 83193 - DNA, 15 bp, Artificial Sequence
  dgRNA
  Prss12
accaccgagaacggg

SEQ ID NO: 83194 - DNA, 15 bp, Artificial Sequence
  dgRNA
  Prss12
ccaccgagaacggga

SEQ ID NO: 83195 - DNA, 15 bp, Artificial Sequence
  dgRNA
  Eme1
ctcaaaagcgaggaa

SEQ ID NO: 83196 - DNA, 15 bp, Artificial Sequence
  dgRNA
  Eme1
agtcttcttcaaatc

SEQ ID NO: 83197 - DNA, 15 bp, Artificial Sequence
  dgRNA
  Eme1
cttcttcaaatccgg

SEQ ID NO: 83198 - DNA, 15 bp, Artificial Sequence
  dgRNA
  Eme1
ttcttcaaatccgga

SEQ ID NO: 83199 - DNA, 15 bp, Artificial Sequence
  dgRNA
  Mettl20
ttcctctcccgaaaa

SEQ ID NO: 83200 - DNA, 15 bp, Artificial Sequence
  dgRNA
  Mettl20
gtgggtacgtgaagg

SEQ ID NO: 83201 - DNA, 15 bp, Artificial Sequence
  dgRNA
  Mettl20
gtagtgggtacgtga

SEQ ID NO: 83202 - DNA, 15 bp, Artificial Sequence
  dgRNA
  Mettl20
actacacagcgtagt

SEQ ID NO: 83203 - DNA, 15 bp, Artificial Sequence
  dgRNA
  Stra6
ggcccaaatcccctg

SEQ ID NO: 83204 - DNA, 15 bp, Artificial Sequence
  dgRNA
  Stra6
cctgcggagtactga

SEQ ID NO: 83205 - DNA, 15 bp, Artificial Sequence
  dgRNA
  Stra6
ctcaccccttcaccg

SEQ ID NO: 83206 - DNA, 15 bp, Artificial Sequence
  dgRNA
  Stra6
ccccttcaccggggc

SEQ ID NO: 83207 - DNA, 15 bp, Artificial Sequence
  dgRNA
  Ins2
gggctggtggttact

SEQ ID NO: 83208 - DNA, 15 bp, Artificial Sequence
  dgRNA
  Olfr672
tgaaggaatctacac

SEQ ID NO: 83209 - DNA, 15 bp, Artificial Sequence
  dgRNA
  Haus4
cctaagcttccgagc

SEQ ID NO: 83210 - DNA, 15 bp, Artificial Sequence
  dgRNA
  Haus4
ctaagcttccgagct

SEQ ID NO: 83211 - DNA, 15 bp, Artificial Sequence
  dgRNA
  Haus4
gaagttccgacttcc

SEQ ID NO: 83212 - DNA, 15 bp, Artificial Sequence
  dgRNA
  Haus4
ctgagcgcgcgctcc

SEQ ID NO: 83213 - DNA, 15 bp, Artificial Sequence
  dgRNA
  4930522H14Rik
catgacttcacctaa

SEQ ID NO: 83214 - DNA, 15 bp, Artificial Sequence
  dgRNA
  Luc7l2
gactcgctctaagct

SEQ ID NO: 83215 - DNA, 15 bp, Artificial Sequence
  dgRNA
  Luc7l2
ctctaagctcggcac

SEQ ID NO: 83216 - DNA, 15 bp, Artificial Sequence
  dgRNA
  Luc7l2
gcactggctaatttg

SEQ ID NO: 83217 - DNA, 15 bp, Artificial Sequence
  dgRNA
  Luc7l2
tggctaatttgcggc

SEQ ID NO: 83218 - DNA, 15 bp, Artificial Sequence
  dgRNA
  Vmn1r197
ccaaaaggtatttcc

SEQ ID NO: 83219 - DNA, 15 bp, Artificial Sequence
  dgRNA
  Vmn1r197
acctaacatttctgg

SEQ ID NO: 83220 - DNA, 15 bp, Artificial Sequence
  dgRNA
  Vmn1r197
aggaatacttaatcc

SEQ ID NO: 83221 - DNA, 15 bp, Artificial Sequence
  dgRNA
  Nagpa
ggcctggaatcacgt

SEQ ID NO: 83222 - DNA, 15 bp, Artificial Sequence
  dgRNA
  Nagpa
cgaattccatcagag

SEQ ID NO: 83223 - DNA, 15 bp, Artificial Sequence
  dgRNA
  Nagpa
acgtgattccaggcc

SEQ ID NO: 83224 - DNA, 15 bp, Artificial Sequence
  dgRNA
  Nagpa
gccccacgtgattcc

SEQ ID NO: 83225 - DNA, 15 bp, Artificial Sequence
  dgRNA
  B3galt2
gatgtgtcacataag

SEQ ID NO: 83226 - DNA, 15 bp, Artificial Sequence
  dgRNA
  B3galt2
tttgaacttatgcac

SEQ ID NO: 83227 - DNA, 15 bp, Artificial Sequence
  dgRNA
  B3galt2
ctaaaaacccgaggt

SEQ ID NO: 83228 - DNA, 15 bp, Artificial Sequence
  dgRNA
  B3galt2
ttgactaaaaacccg

SEQ ID NO: 83229 - DNA, 15 bp, Artificial Sequence
  dgRNA
  Glycam1
agtagctaggccaaa

SEQ ID NO: 83230 - DNA, 15 bp, Artificial Sequence
  dgRNA
  Glycam1
gctaggccaaaggga

SEQ ID NO: 83231 - DNA, 15 bp, Artificial Sequence
  dgRNA
  Glycam1
caatgtagtctgaat

SEQ ID NO: 83232 - DNA, 15 bp, Artificial Sequence
  dgRNA
  Glycam1
gcctagctactgcca

SEQ ID NO: 83233 - DNA, 15 bp, Artificial Sequence
  dgRNA
  Skint4
gtatatgacaggtat

SEQ ID NO: 83234 - DNA, 15 bp, Artificial Sequence
  dgRNA
  Skint4
ggtatgggtcagacc

SEQ ID NO: 83235 - DNA, 15 bp, Artificial Sequence
  dgRNA
  Skint4
gacttgctccaccca

SEQ ID NO: 83236 - DNA, 15 bp, Artificial Sequence
  dgRNA
  Skint4
agacttgctccaccc

SEQ ID NO: 83237 - DNA, 15 bp, Artificial Sequence
  dgRNA
  3632451O06Rik
ctcttgaagggcccc

SEQ ID NO: 83238 - DNA, 15 bp, Artificial Sequence
  dgRNA
  3632451O06Rik
gaagggccccgggct

SEQ ID NO: 83239 - DNA, 15 bp, Artificial Sequence
  dgRNA
  3632451O06Rik
aagggccccgggctc

SEQ ID NO: 83240 - DNA, 15 bp, Artificial Sequence
  dgRNA
  3632451O06Rik
agccctgtgcgttag

SEQ ID NO: 83241 - DNA, 15 bp, Artificial Sequence
  dgRNA
  Olfr699
catcaattcaaaatt

SEQ ID NO: 83242 - DNA, 15 bp, Artificial Sequence
  dgRNA
  Olfr699
aaagctactcactag

SEQ ID NO: 83243 - DNA, 15 bp, Artificial Sequence
  dgRNA
  Olfr699
aagctactcactagt

SEQ ID NO: 83244 - DNA, 15 bp, Artificial Sequence
  dgRNA
  Olfr699
tgaaccatcttaggt

SEQ ID NO: 83245 - DNA, 15 bp, Artificial Sequence
  dgRNA
  Fbf1
gctcctagcaactcg

SEQ ID NO: 83246 - DNA, 15 bp, Artificial Sequence
  dgRNA
  Fbf1
gccttgcccccgctg

SEQ ID NO: 83247 - DNA, 15 bp, Artificial Sequence
  dgRNA
  Fbf1
ccttgcccccgctgc

SEQ ID NO: 83248 - DNA, 15 bp, Artificial Sequence
  dgRNA
  Fbf1
cttgcccccgctgcg

SEQ ID NO: 83249 - DNA, 15 bp, Artificial Sequence
  dgRNA
  Gipc3
gttgttcgcgagtcc

SEQ ID NO: 83250 - DNA, 15 bp, Artificial Sequence
  dgRNA
  Gipc3
ttgttcgcgagtccc

SEQ ID NO: 83251 - DNA, 15 bp, Artificial Sequence
  dgRNA
  Gipc3
tgttcgcgagtcccg

SEQ ID NO: 83252 - DNA, 15 bp, Artificial Sequence
  dgRNA
  Gipc3
gttcgcgagtcccgg

SEQ ID NO: 83253 - DNA, 15 bp, Artificial Sequence
  dgRNA
  Slit3
gcggagctggtgttt

SEQ ID NO: 83254 - DNA, 15 bp, Artificial Sequence
  dgRNA
  Slit3
cggagctggtgtttt

SEQ ID NO: 83255 - DNA, 15 bp, Artificial Sequence
  dgRNA
  Slit3
cgggccccgcgtctc

SEQ ID NO: 83256 - DNA, 15 bp, Artificial Sequence
  dgRNA
  Slit3
ggagaaagcgagcgc

SEQ ID NO: 83257 - DNA, 15 bp, Artificial Sequence
  dgRNA
  Ccm2
tggacaaagttggac

SEQ ID NO: 83258 - DNA, 15 bp, Artificial Sequence
  dgRNA
  Ccm2
tgattcagttcagcg

SEQ ID NO: 83259 - DNA, 15 bp, Artificial Sequence
  dgRNA
  Ccm2
cctataaggaagcat

SEQ ID NO: 83260 - DNA, 15 bp, Artificial Sequence
  dgRNA
  Ccm2
ctagaccatcctata

SEQ ID NO: 83261 - DNA, 15 bp, Artificial Sequence
  dgRNA
  Nfix
cgagcggccgagcgg

SEQ ID NO: 83262 - DNA, 15 bp, Artificial Sequence
  dgRNA
  Nfix
cgagcggcggcggca

SEQ ID NO: 83263 - DNA, 15 bp, Artificial Sequence
  dgRNA
  Nfix
ggagtagacgcgcgg

SEQ ID NO: 83264 - DNA, 15 bp, Artificial Sequence
  dgRNA
  Nfix
gtagacgcgcggcgg

SEQ ID NO: 83265 - DNA, 15 bp, Artificial Sequence
  dgRNA
  Slc35c1
atctccggggactcc

SEQ ID NO: 83266 - DNA, 15 bp, Artificial Sequence
  dgRNA
  Slc35c1
gactcccggaagaag

SEQ ID NO: 83267 - DNA, 15 bp, Artificial Sequence
  dgRNA
  Slc35c1
actcccggaagaaga

SEQ ID NO: 83268 - DNA, 15 bp, Artificial Sequence
  dgRNA
  Slc35c1
ccggaagaagagggc

SEQ ID NO: 83269 - DNA, 15 bp, Artificial Sequence
  dgRNA
  Fam161b
tggaaagtgcttccg

SEQ ID NO: 83270 - DNA, 15 bp, Artificial Sequence
  dgRNA
  Fam161b
gtcgtcaaccttgtg

SEQ ID NO: 83271 - DNA, 15 bp, Artificial Sequence
  dgRNA
  Fam161b
acgctcttgcctcat

SEQ ID NO: 83272 - DNA, 15 bp, Artificial Sequence
  dgRNA
  Fam161b
cgctcttgcctcatt

SEQ ID NO: 83273 - DNA, 15 bp, Artificial Sequence
  dgRNA
  Tmem143
aaaggactagcgatg

SEQ ID NO: 83274 - DNA, 15 bp, Artificial Sequence
  dgRNA
  Tmem143
gcgcagttgagataa

SEQ ID NO: 83275 - DNA, 15 bp, Artificial Sequence
  dgRNA
  Tmem143
ggtttcaagcggctc

SEQ ID NO: 83276 - DNA, 15 bp, Artificial Sequence
  dgRNA
  Tmem143
ccgctatttggagct

SEQ ID NO: 83277 - DNA, 15 bp, Artificial Sequence
  dgRNA
  Glis2
gctccgtctggcagc

SEQ ID NO: 83278 - DNA, 15 bp, Artificial Sequence
  dgRNA
  Glis2
tggcgctccgggcct

SEQ ID NO: 83279 - DNA, 15 bp, Artificial Sequence
  dgRNA
  Glis2
ggcgctccgggcctg

SEQ ID NO: 83280 - DNA, 15 bp, Artificial Sequence
  dgRNA
  Glis2
ggccgcagtagtgag

SEQ ID NO: 83281 - DNA, 15 bp, Artificial Sequence
  dgRNA
  Dnah7a
gcagatgcagacgac

SEQ ID NO: 83282 - DNA, 15 bp, Artificial Sequence
  dgRNA
  Dnah7a
gcaacgaatcgacca

SEQ ID NO: 83283 - DNA, 15 bp, Artificial Sequence
  dgRNA
  Dnah7a
acgaatcgaccacgg

SEQ ID NO: 83284 - DNA, 15 bp, Artificial Sequence
  dgRNA
  Dnah7a
ctgagaggtcgagca

SEQ ID NO: 83285 - DNA, 15 bp, Artificial Sequence
  dgRNA
  Tectb
aggggttagagattt

SEQ ID NO: 83286 - DNA, 15 bp, Artificial Sequence
  dgRNA
  Tectb
atcaccgagctctct

SEQ ID NO: 83287 - DNA, 15 bp, Artificial Sequence
  dgRNA
  Tectb
ccttatatatctaga

SEQ ID NO: 83288 - DNA, 15 bp, Artificial Sequence
  dgRNA
  Tectb
tccttatatatctag

SEQ ID NO: 83289 - DNA, 15 bp, Artificial Sequence
  dgRNA
  Fnip1
gccccgccccgtgag

SEQ ID NO: 83290 - DNA, 15 bp, Artificial Sequence
  dgRNA
  Fnip1
tgagaggccgcgtga

SEQ ID NO: 83291 - DNA, 15 bp, Artificial Sequence
  dgRNA
  Fnip1
ccgtgagccagccaa

SEQ ID NO: 83292 - DNA, 15 bp, Artificial Sequence
  dgRNA
  Fnip1
tgctgccacgtgata

SEQ ID NO: 83293 - DNA, 15 bp, Artificial Sequence
  dgRNA
  Sult2a7
agacatgcccaagcc

SEQ ID NO: 83294 - DNA, 15 bp, Artificial Sequence
  dgRNA
  Sult2a7
ctacgtttggtttga

SEQ ID NO: 83295 - DNA, 15 bp, Artificial Sequence
  dgRNA
  Sult2a7
gttctactccaggct

SEQ ID NO: 83296 - DNA, 15 bp, Artificial Sequence
  dgRNA
  Srgap3
gttataaaatccggg

SEQ ID NO: 83297 - DNA, 15 bp, Artificial Sequence
  dgRNA
  Srgap3
ataaaatccgggagg

SEQ ID NO: 83298 - DNA, 15 bp, Artificial Sequence
  dgRNA
  Srgap3
cggagtctagtgacg

SEQ ID NO: 83299 - DNA, 15 bp, Artificial Sequence
  dgRNA
  Srgap3
ggagtctagtgacga

SEQ ID NO: 83300 - DNA, 15 bp, Artificial Sequence
  dgRNA
  Commd4
cctccaagtaattaa

SEQ ID NO: 83301 - DNA, 15 bp, Artificial Sequence
  dgRNA
  Commd4
ctgtttagataatcc

SEQ ID NO: 83302 - DNA, 15 bp, Artificial Sequence
  dgRNA
  Commd4
ccggtgaaacgctag

SEQ ID NO: 83303 - DNA, 15 bp, Artificial Sequence
  dgRNA
  Commd4
ccattaattacttgg

SEQ ID NO: 83304 - DNA, 15 bp, Artificial Sequence
  dgRNA
  Matk
ttgggagagctcacg

SEQ ID NO: 83305 - DNA, 15 bp, Artificial Sequence
  dgRNA
  Matk
tgggagagctcacgg

SEQ ID NO: 83306 - DNA, 15 bp, Artificial Sequence
  dgRNA
  Matk
gggagagctcacggg

SEQ ID NO: 83307 - DNA, 15 bp, Artificial Sequence
  dgRNA
  Matk
ggagagctcacgggg

SEQ ID NO: 83308 - DNA, 15 bp, Artificial Sequence
  dgRNA
  Trip4
tgccactggtcgtcc

SEQ ID NO: 83309 - DNA, 15 bp, Artificial Sequence
  dgRNA
  Trip4
tctcactcgtagatc

SEQ ID NO: 83310 - DNA, 15 bp, Artificial Sequence
  dgRNA
  Trip4
gcctgcgcgaccgag

SEQ ID NO: 83311 - DNA, 15 bp, Artificial Sequence
  dgRNA
  Trip4
cctgcgcgaccgagc

SEQ ID NO: 83312 - DNA, 15 bp, Artificial Sequence
  dgRNA
  Psen2
ggcaagacacagcga

SEQ ID NO: 83313 - DNA, 15 bp, Artificial Sequence
  dgRNA
  Psen2
gtaaaccgacgatga

SEQ ID NO: 83314 - DNA, 15 bp, Artificial Sequence
  dgRNA
  Psen2
aaggcgcaagtgcac

SEQ ID NO: 83315 - DNA, 15 bp, Artificial Sequence
  dgRNA
  Psen2
aggcgcaagtgcaca

SEQ ID NO: 83316 - DNA, 15 bp, Artificial Sequence
  dgRNA
  Phb
gctgcatgatctttt

SEQ ID NO: 83317 - DNA, 15 bp, Artificial Sequence
  dgRNA
  Phb
agaatgcacgtcgct

SEQ ID NO: 83318 - DNA, 15 bp, Artificial Sequence
  dgRNA
  Phb
ggcttcaccaattga

SEQ ID NO: 83319 - DNA, 15 bp, Artificial Sequence
  dgRNA
  Phb
gcttcaccaattgaa

SEQ ID NO: 83320 - DNA, 15 bp, Artificial Sequence
  dgRNA
  Sctr
tctatgcgggtgtct

SEQ ID NO: 83321 - DNA, 15 bp, Artificial Sequence
  dgRNA
  Sctr
ctatgcgggtgtcta

SEQ ID NO: 83322 - DNA, 15 bp, Artificial Sequence
  dgRNA
  Sctr
cctgctattccctgc

SEQ ID NO: 83323 - DNA, 15 bp, Artificial Sequence
  dgRNA
  Sctr
ctattccctgcaggg

SEQ ID NO: 83324 - DNA, 15 bp, Artificial Sequence
  dgRNA
  4930502E18Rik
ggaggtcattttacg

SEQ ID NO: 83325 - DNA, 15 bp, Artificial Sequence
  dgRNA
  4930502E18Rik
ttttacgtggagtac

SEQ ID NO: 83326 - DNA, 15 bp, Artificial Sequence
  dgRNA
  4930502E18Rik
ttcagcgctatgtga

SEQ ID NO: 83327 - DNA, 15 bp, Artificial Sequence
  dgRNA
  4930502E18Rik
tcagcgctatgtgat

SEQ ID NO: 83328 - DNA, 15 bp, Artificial Sequence
  dgRNA
  Pigh
taatctgcccaaaac

SEQ ID NO: 83329 - DNA, 15 bp, Artificial Sequence
  dgRNA
  Pigh
ccaaaactggtgccg

SEQ ID NO: 83330 - DNA, 15 bp, Artificial Sequence
  dgRNA
  Pigh
ctggtgccgcggttc

SEQ ID NO: 83331 - DNA, 15 bp, Artificial Sequence
  dgRNA
  Pigh
tggtgccgcggttct

SEQ ID NO: 83332 - DNA, 15 bp, Artificial Sequence
  dgRNA
  Mstn
cagcgagattcattg

SEQ ID NO: 83333 - DNA, 15 bp, Artificial Sequence
  dgRNA
  Mstn
gattcattgtggagc

SEQ ID NO: 83334 - DNA, 15 bp, Artificial Sequence
  dgRNA
  Mstn
ttttgttacagtcga

SEQ ID NO: 83335 - DNA, 15 bp, Artificial Sequence
  dgRNA
  Mstn
gaatctcgctgtcag

SEQ ID NO: 83336 - DNA, 15 bp, Artificial Sequence
  dgRNA
  Aim1
cagcacgcgactatc

SEQ ID NO: 83337 - DNA, 15 bp, Artificial Sequence
  dgRNA
  Aim1
tgaataggtacagcc

SEQ ID NO: 83338 - DNA, 15 bp, Artificial Sequence
  dgRNA
  Aim1
ccttggcaatggacc

SEQ ID NO: 83339 - DNA, 15 bp, Artificial Sequence
  dgRNA
  Aim1
gaaccaccttggcaa

SEQ ID NO: 83340 - DNA, 15 bp, Artificial Sequence
  dgRNA
  Dkk3
cctcccaggatttag

SEQ ID NO: 83341 - DNA, 15 bp, Artificial Sequence
  dgRNA
  Dkk3
agctgaggtcgcaga

SEQ ID NO: 83342 - DNA, 15 bp, Artificial Sequence
  dgRNA
  Dkk3
aggtcgcagacggcc

SEQ ID NO: 83343 - DNA, 15 bp, Artificial Sequence
  dgRNA
  Dkk3
ggcctggagagcgat

SEQ ID NO: 83344 - DNA, 15 bp, Artificial Sequence
  dgRNA
  Ywhaq
ggtgcagcgttctat

SEQ ID NO: 83345 - DNA, 15 bp, Artificial Sequence
  dgRNA
  Ywhaq
cagcgttctattggt

SEQ ID NO: 83346 - DNA, 15 bp, Artificial Sequence
  dgRNA
  Ywhaq
cgttctattggtcgg

SEQ ID NO: 83347 - DNA, 15 bp, Artificial Sequence
  dgRNA
  Ywhaq
cggtggcgagctcgt

SEQ ID NO: 83348 - DNA, 15 bp, Artificial Sequence
  dgRNA
  Tlr9
atatgtgataccctt

SEQ ID NO: 83349 - DNA, 15 bp, Artificial Sequence
  dgRNA
  Tlr9
ccctttggctgattg

SEQ ID NO: 83350 - DNA, 15 bp, Artificial Sequence
  dgRNA
  Tlr9
cctttggctgattgt

SEQ ID NO: 83351 - DNA, 15 bp, Artificial Sequence
  dgRNA
  Tlr9
ccacaatcagccaaa

SEQ ID NO: 83352 - DNA, 15 bp, Artificial Sequence
  dgRNA
  Arpp21
tcttgtataaccagc

SEQ ID NO: 83353 - DNA, 15 bp, Artificial Sequence
  dgRNA
  Arpp21
cttgtataaccagca

SEQ ID NO: 83354 - DNA, 15 bp, Artificial Sequence
  dgRNA
  Arpp21
agtgcgttctagaag

SEQ ID NO: 83355 - DNA, 15 bp, Artificial Sequence
  dgRNA
  Arpp21
cgttctagaagaggc

SEQ ID NO: 83356 - DNA, 15 bp, Artificial Sequence
  dgRNA
  Tm9sf2
tcctgagcggactga

SEQ ID NO: 83357 - DNA, 15 bp, Artificial Sequence
  dgRNA
  Tm9sf2
cctgagcggactgac

SEQ ID NO: 83358 - DNA, 15 bp, Artificial Sequence
  dgRNA
  Tm9sf2
ggactgacgggtatg

SEQ ID NO: 83359 - DNA, 15 bp, Artificial Sequence
  dgRNA
  Tm9sf2
tgcgcccgagaagcg

SEQ ID NO: 83360 - DNA, 15 bp, Artificial Sequence
  dgRNA
  Trim29
atgaagcagcctaac

SEQ ID NO: 83361 - DNA, 15 bp, Artificial Sequence
  dgRNA
  Trim29
ctaacaggttgtcag

SEQ ID NO: 83362 - DNA, 15 bp, Artificial Sequence
  dgRNA
  Trim29
tttaaaatcccgggc

SEQ ID NO: 83363 - DNA, 15 bp, Artificial Sequence
  dgRNA
  Trim29
ttaaaatcccgggct

SEQ ID NO: 83364 - DNA, 15 bp, Artificial Sequence
  dgRNA
  Olfr527
tgtaatactgaggtt

SEQ ID NO: 83365 - DNA, 15 bp, Artificial Sequence
  dgRNA
  Olfr527
gtttgggctctaggt

SEQ ID NO: 83366 - DNA, 15 bp, Artificial Sequence
  dgRNA
  Olfr527
gtcgttagcacaaac

SEQ ID NO: 83367 - DNA, 15 bp, Artificial Sequence
  dgRNA
  Olfr527
tctaggagactgatg

SEQ ID NO: 83368 - DNA, 15 bp, Artificial Sequence
  dgRNA
  Ppp2r4
cgccccgcacaaaca

SEQ ID NO: 83369 - DNA, 15 bp, Artificial Sequence
  dgRNA
  Ppp2r4
tgccagcgccgcagt

SEQ ID NO: 83370 - DNA, 15 bp, Artificial Sequence
  dgRNA
  Ppp2r4
ccgcagttggcttgc

SEQ ID NO: 83371 - DNA, 15 bp, Artificial Sequence
  dgRNA
  Ppp2r4
tattcttgcggagca

SEQ ID NO: 83372 - DNA, 15 bp, Artificial Sequence
  dgRNA
  Ghrh
tgaccttactcagag

SEQ ID NO: 83373 - DNA, 15 bp, Artificial Sequence
  dgRNA
  Ghrh
ctataacccgaaaac

SEQ ID NO: 83374 - DNA, 15 bp, Artificial Sequence
  dgRNA
  Ghrh
gccatgtacgtgctc

SEQ ID NO: 83375 - DNA, 15 bp, Artificial Sequence
  dgRNA
  Ghrh
taagatgagatcgtc

SEQ ID NO: 83376 - DNA, 15 bp, Artificial Sequence
  dgRNA
  Myoz2
attcaactatctcag

SEQ ID NO: 83377 - DNA, 15 bp, Artificial Sequence
  dgRNA
  Myoz2
tccctccctttcgcc

SEQ ID NO: 83378 - DNA, 15 bp, Artificial Sequence
  dgRNA
  Myoz2
gtaccacagccaaaa

SEQ ID NO: 83379 - DNA, 15 bp, Artificial Sequence
  dgRNA
  Myoz2
ctgaacactttccgt

SEQ ID NO: 83380 - DNA, 15 bp, Artificial Sequence
  dgRNA
  Henmt1
cccttaaagtgtata

SEQ ID NO: 83381 - DNA, 15 bp, Artificial Sequence
  dgRNA
  Henmt1
aaaagttcagagcgt

SEQ ID NO: 83382 - DNA, 15 bp, Artificial Sequence
  dgRNA
  Henmt1
agttcagagcgtagg

SEQ ID NO: 83383 - DNA, 15 bp, Artificial Sequence
  dgRNA
  Henmt1
cagagcgtaggtggt

SEQ ID NO: 83384 - DNA, 15 bp, Artificial Sequence
  dgRNA
  Tmem71
tgatgcgatcgtgac

SEQ ID NO: 83385 - DNA, 15 bp, Artificial Sequence
  dgRNA
  Tmem71
gccctgcctctagtt

SEQ ID NO: 83386 - DNA, 15 bp, Artificial Sequence
  dgRNA
  Tmem71
gcctctagttcggaa

SEQ ID NO: 83387 - DNA, 15 bp, Artificial Sequence
  dgRNA
  Tmem71
tcacgatcgcatcag

SEQ ID NO: 83388 - DNA, 15 bp, Artificial Sequence
  dgRNA
  Dgat2l6
gctttagctgtcggg

SEQ ID NO: 83389 - DNA, 15 bp, Artificial Sequence
  dgRNA
  Dgat2l6
cttcctacacacata

SEQ ID NO: 83390 - DNA, 15 bp, Artificial Sequence
  dgRNA
  Kcnd3
cttgtatcactattg

SEQ ID NO: 83391 - DNA, 15 bp, Artificial Sequence
  dgRNA
  Kcnd3
acagcacctcccaag

SEQ ID NO: 83392 - DNA, 15 bp, Artificial Sequence
  dgRNA
  Kcnd3
cacaatagtgataca

SEQ ID NO: 83393 - DNA, 15 bp, Artificial Sequence
  dgRNA
  Kcnd3
tgagttttgacggaa

SEQ ID NO: 83394 - DNA, 15 bp, Artificial Sequence
  dgRNA
  Dhx29
caaccactgcgagtc

SEQ ID NO: 83395 - DNA, 15 bp, Artificial Sequence
  dgRNA
  Dhx29
aaacttagcgaccag

SEQ ID NO: 83396 - DNA, 15 bp, Artificial Sequence
  dgRNA
  Dhx29
catgccgctcgctcc

SEQ ID NO: 83397 - DNA, 15 bp, Artificial Sequence
  dgRNA
  Dhx29
atgccgctcgctccc

SEQ ID NO: 83398 - DNA, 15 bp, Artificial Sequence
  dgRNA
  Pik3ca
tggttgctctaaact

SEQ ID NO: 83399 - DNA, 15 bp, Artificial Sequence
  dgRNA
  Pik3ca
gtgttttaatctaga

SEQ ID NO: 83400 - DNA, 15 bp, Artificial Sequence
  dgRNA
  Clec1a
cgggtctctccatgc

SEQ ID NO: 83401 - DNA, 15 bp, Artificial Sequence
  dgRNA
  Clec1a
tcctagtagcactga

SEQ ID NO: 83402 - DNA, 15 bp, Artificial Sequence
  dgRNA
  Clec1a
tcagagttgcaaggt

SEQ ID NO: 83403 - DNA, 15 bp, Artificial Sequence
  dgRNA
  Clec1a
cgcgtgtttctggct

SEQ ID NO: 83404 - DNA, 15 bp, Artificial Sequence
  dgRNA
  H2-Ab1
caaacgttcatccag

SEQ ID NO: 83405 - DNA, 15 bp, Artificial Sequence
  dgRNA
  H2-Ab1
aaacgttcatccagt

SEQ ID NO: 83406 - DNA, 15 bp, Artificial Sequence
  dgRNA
  H2-Ab1
aacgttcatccagtg

SEQ ID NO: 83407 - DNA, 15 bp, Artificial Sequence
  dgRNA
  H2-Ab1
agctccaatgctgat

SEQ ID NO: 83408 - DNA, 15 bp, Artificial Sequence
  dgRNA
  Cyb5r3
accgttctgcactag

SEQ ID NO: 83409 - DNA, 15 bp, Artificial Sequence
  dgRNA
  Cyb5r3
actagtggcgtccct

SEQ ID NO: 83410 - DNA, 15 bp, Artificial Sequence
  dgRNA
  Cyb5r3
agtggcgtcccttgg

SEQ ID NO: 83411 - DNA, 15 bp, Artificial Sequence
  dgRNA
  Cyb5r3
gtggcgtcccttgga

SEQ ID NO: 83412 - DNA, 15 bp, Artificial Sequence
  dgRNA
  Paox
tccgaatgttcacca

SEQ ID NO: 83413 - DNA, 15 bp, Artificial Sequence
  dgRNA
  Paox
gctttcctcccgtct

SEQ ID NO: 83414 - DNA, 15 bp, Artificial Sequence
  dgRNA
  Paox
gtccacgtaggcttg

SEQ ID NO: 83415 - DNA, 15 bp, Artificial Sequence
  dgRNA
  Paox
tcggaactggactga

SEQ ID NO: 83416 - DNA, 15 bp, Artificial Sequence
  dgRNA
  Itpr3
gaacgccctagagcc

SEQ ID NO: 83417 - DNA, 15 bp, Artificial Sequence
  dgRNA
  Itpr3
aacgccctagagcct

SEQ ID NO: 83418 - DNA, 15 bp, Artificial Sequence
  dgRNA
  Itpr3
cgccctagagcctgg

SEQ ID NO: 83419 - DNA, 15 bp, Artificial Sequence
  dgRNA
  Itpr3
agcctgggggtcgtc

SEQ ID NO: 83420 - DNA, 15 bp, Artificial Sequence
  dgRNA
  Colec12
gaatgcaggtcgggc

SEQ ID NO: 83421 - DNA, 15 bp, Artificial Sequence
  dgRNA
  Colec12
aagagggacccacga

SEQ ID NO: 83422 - DNA, 15 bp, Artificial Sequence
  dgRNA
  Colec12
gacccacgagggtgc

SEQ ID NO: 83423 - DNA, 15 bp, Artificial Sequence
  dgRNA
  Colec12
acccacgagggtgcg

SEQ ID NO: 83424 - DNA, 15 bp, Artificial Sequence
  dgRNA
  Tdrp
ccttggtaaagcact

SEQ ID NO: 83425 - DNA, 15 bp, Artificial Sequence
  dgRNA
  Tdrp
ggcccgctgattccc

SEQ ID NO: 83426 - DNA, 15 bp, Artificial Sequence
  dgRNA
  Tdrp
gcccgctgattccct

SEQ ID NO: 83427 - DNA, 15 bp, Artificial Sequence
  dgRNA
  Tdrp
cccgctgattccctg

SEQ ID NO: 83428 - DNA, 15 bp, Artificial Sequence
  dgRNA
  Zfp667
ccaaccaaattattg

SEQ ID NO: 83429 - DNA, 15 bp, Artificial Sequence
  dgRNA
  Zfp667
aaattattgagggcg

SEQ ID NO: 83430 - DNA, 15 bp, Artificial Sequence
  dgRNA
  Zfp667
gcctcgcgctgtctc

SEQ ID NO: 83431 - DNA, 15 bp, Artificial Sequence
  dgRNA
  Zfp667
cctcgcgctgtctcc

SEQ ID NO: 83432 - DNA, 15 bp, Artificial Sequence
  dgRNA
  Nol3
cccctgactcaaatc

SEQ ID NO: 83433 - DNA, 15 bp, Artificial Sequence
  dgRNA
  Nol3
caaatccgggtgctt

SEQ ID NO: 83434 - DNA, 15 bp, Artificial Sequence
  dgRNA
  Nol3
aaatccgggtgcttt

SEQ ID NO: 83435 - DNA, 15 bp, Artificial Sequence
  dgRNA
  Nol3
cggatttgagtcagg

SEQ ID NO: 83436 - DNA, 15 bp, Artificial Sequence
  dgRNA
  Sox11
agaagcgcgcgcgcc

SEQ ID NO: 83437 - DNA, 15 bp, Artificial Sequence
  dgRNA
  Sox11
gaagcgcgcgcgcct

SEQ ID NO: 83438 - DNA, 15 bp, Artificial Sequence
  dgRNA
  Sox11
gcgcctgggagtgct

SEQ ID NO: 83439 - DNA, 15 bp, Artificial Sequence
  dgRNA
  Sox11
ggggtccggcgcttg

SEQ ID NO: 83440 - DNA, 15 bp, Artificial Sequence
  dgRNA
  2410089E03Rik
accccggcgcaaagc

SEQ ID NO: 83441 - DNA, 15 bp, Artificial Sequence
  dgRNA
  2410089E03Rik
aagctggctacgccg

SEQ ID NO: 83442 - DNA, 15 bp, Artificial Sequence
  dgRNA
  2410089E03Rik
ctggctacgccgagg

SEQ ID NO: 83443 - DNA, 15 bp, Artificial Sequence
  dgRNA
  2410089E03Rik
gctacgccgaggagg

SEQ ID NO: 83444 - DNA, 15 bp, Artificial Sequence
  dgRNA
  Rab8a
ggagaaggcgcgcac

SEQ ID NO: 83445 - DNA, 15 bp, Artificial Sequence
  dgRNA
  Rab8a
aaggcgcgcacggga

SEQ ID NO: 83446 - DNA, 15 bp, Artificial Sequence
  dgRNA
  Rab8a
gcgcgcacgggaagg

SEQ ID NO: 83447 - DNA, 15 bp, Artificial Sequence
  dgRNA
  Rab8a
cgcgcacgggaaggc

SEQ ID NO: 83448 - DNA, 15 bp, Artificial Sequence
  dgRNA
  Sfxn1
cattgacccgggctg

SEQ ID NO: 83449 - DNA, 15 bp, Artificial Sequence
  dgRNA
  Sfxn1
ggctaagatgaactt

SEQ ID NO: 83450 - DNA, 15 bp, Artificial Sequence
  dgRNA
  Sfxn1
agaagcgcgggcaca

SEQ ID NO: 83451 - DNA, 15 bp, Artificial Sequence
  dgRNA
  Sfxn1
gaagcgcgggcacat

SEQ ID NO: 83452 - DNA, 15 bp, Artificial Sequence
  dgRNA
  Lrrfip2
cggtggcggggcaga

SEQ ID NO: 83453 - DNA, 15 bp, Artificial Sequence
  dgRNA
  Zwint
aaccaatctcgacct

SEQ ID NO: 83454 - DNA, 15 bp, Artificial Sequence
  dgRNA
  Zwint
caatctcgacctagg

SEQ ID NO: 83455 - DNA, 15 bp, Artificial Sequence
  dgRNA
  Zwint
aatctcgacctaggc

SEQ ID NO: 83456 - DNA, 15 bp, Artificial Sequence
  dgRNA
  Zwint
tcgagattggtttct

SEQ ID NO: 83457 - DNA, 15 bp, Artificial Sequence
  dgRNA
  Tbp
gtagaacgcttgctt

SEQ ID NO: 83458 - DNA, 15 bp, Artificial Sequence
  dgRNA
  Tbp
gctagaaagggccgt

SEQ ID NO: 83459 - DNA, 15 bp, Artificial Sequence
  dgRNA
  Tbp
agaaagggccgtcgg

SEQ ID NO: 83460 - DNA, 15 bp, Artificial Sequence
  dgRNA
  Tbp
tcggaggccccgccc

SEQ ID NO: 83461 - DNA, 15 bp, Artificial Sequence
  dgRNA
  Olfr1496
agtaatactattcag

SEQ ID NO: 83462 - DNA, 15 bp, Artificial Sequence
  dgRNA
  Ppid
ggcagagtcgaggct

SEQ ID NO: 83463 - DNA, 15 bp, Artificial Sequence
  dgRNA
  Ppid
gagtcgaggctagga

SEQ ID NO: 83464 - DNA, 15 bp, Artificial Sequence
  dgRNA
  Ppid
ctaaaaagaaaccga

SEQ ID NO: 83465 - DNA, 15 bp, Artificial Sequence
  dgRNA
  Ppid
gaagcattaggggcc

SEQ ID NO: 83466 - DNA, 15 bp, Artificial Sequence
  dgRNA
  Arhgef6
agtgctcgtggaaac

SEQ ID NO: 83467 - DNA, 15 bp, Artificial Sequence
  dgRNA
  Arhgef6
gtcagcaagtgctcg

SEQ ID NO: 83468 - DNA, 15 bp, Artificial Sequence
  dgRNA
  Ppp3r1
ctgccggccttcctt

SEQ ID NO: 83469 - DNA, 15 bp, Artificial Sequence
  dgRNA
  Ppp3r1
cttcggtcacatgac

SEQ ID NO: 83470 - DNA, 15 bp, Artificial Sequence
  dgRNA
  Ppp3r1
atgtcccccggcgca

SEQ ID NO: 83471 - DNA, 15 bp, Artificial Sequence
  dgRNA
  Ppp3r1
gtacgcaaaaagcgc

SEQ ID NO: 83472 - DNA, 15 bp, Artificial Sequence
  dgRNA
  Ttc16
agcgacgcccaatcc

SEQ ID NO: 83473 - DNA, 15 bp, Artificial Sequence
  dgRNA
  Ttc16
acgcccaatccaggc

SEQ ID NO: 83474 - DNA, 15 bp, Artificial Sequence
  dgRNA
  Ttc16
cgcccaatccaggct

SEQ ID NO: 83475 - DNA, 15 bp, Artificial Sequence
  dgRNA
  Ttc16
tccgccatgtctctg

SEQ ID NO: 83476 - DNA, 15 bp, Artificial Sequence
  dgRNA
  Sox17
cggaaaaactcagct

SEQ ID NO: 83477 - DNA, 15 bp, Artificial Sequence
  dgRNA
  Sox17
ggaaaaactcagcta

SEQ ID NO: 83478 - DNA, 15 bp, Artificial Sequence
  dgRNA
  Sox17
tcagctagggccgag

SEQ ID NO: 83479 - DNA, 15 bp, Artificial Sequence
  dgRNA
  Sox17
cagctagggccgagc

SEQ ID NO: 83480 - DNA, 15 bp, Artificial Sequence
  dgRNA
  Rab33b
ttccgccccgctcca

SEQ ID NO: 83481 - DNA, 15 bp, Artificial Sequence
  dgRNA
  Rab33b
cgctccacggaggcc

SEQ ID NO: 83482 - DNA, 15 bp, Artificial Sequence
  dgRNA
  Rab33b
ggaagcggtgagcac

SEQ ID NO: 83483 - DNA, 15 bp, Artificial Sequence
  dgRNA
  Rab33b
gaagcggtgagcaca

SEQ ID NO: 83484 - DNA, 15 bp, Artificial Sequence
  dgRNA
  Stox1
gagaactagcctgag

SEQ ID NO: 83485 - DNA, 15 bp, Artificial Sequence
  dgRNA
  Stox1
tcaggaacggagcag

SEQ ID NO: 83486 - DNA, 15 bp, Artificial Sequence
  dgRNA
  Stox1
gcgacctgggtcctc

SEQ ID NO: 83487 - DNA, 15 bp, Artificial Sequence
  dgRNA
  Stox1
cgacctgggtcctcc

SEQ ID NO: 83488 - DNA, 15 bp, Artificial Sequence
  dgRNA
  Cdk5
ccgagcgcagcctgt

SEQ ID NO: 83489 - DNA, 15 bp, Artificial Sequence
  dgRNA
  Cdk5
cgccacaggcattct

SEQ ID NO: 83490 - DNA, 15 bp, Artificial Sequence
  dgRNA
  Cdk5
ccagatgccagtgcg

SEQ ID NO: 83491 - DNA, 15 bp, Artificial Sequence
  dgRNA
  Cdk5
cagtgcgtggtgagc

SEQ ID NO: 83492 - DNA, 15 bp, Artificial Sequence
  dgRNA
  Fpr2
ccgaagagtgtaaga

SEQ ID NO: 83493 - DNA, 15 bp, Artificial Sequence
  dgRNA
  Lbh
cgggctcgtagctgc

SEQ ID NO: 83494 - DNA, 15 bp, Artificial Sequence
  dgRNA
  Lbh
gggctcgtagctgct

SEQ ID NO: 83495 - DNA, 15 bp, Artificial Sequence
  dgRNA
  Lbh
ggtgcagagcccggc

SEQ ID NO: 83496 - DNA, 15 bp, Artificial Sequence
  dgRNA
  Lbh
acgttattctaagag

SEQ ID NO: 83497 - DNA, 15 bp, Artificial Sequence
  dgRNA
  Prkg1
ctccccaaagcgccg

SEQ ID NO: 83498 - DNA, 15 bp, Artificial Sequence
  dgRNA
  Prkg1
gctcatccctaaacc

SEQ ID NO: 83499 - DNA, 15 bp, Artificial Sequence
  dgRNA
  Prkg1
ctaaacccggagaag

SEQ ID NO: 83500 - DNA, 15 bp, Artificial Sequence
  dgRNA
  Prkg1
ctggagcggcggact

SEQ ID NO: 83501 - DNA, 15 bp, Artificial Sequence
  dgRNA
  2310030G06Rik
gagataactctcacc

SEQ ID NO: 83502 - DNA, 15 bp, Artificial Sequence
  dgRNA
  2310030G06Rik
ctgcgaacagtcact

SEQ ID NO: 83503 - DNA, 15 bp, Artificial Sequence
  dgRNA
  2310030G06Rik
tgcgaacagtcactt

SEQ ID NO: 83504 - DNA, 15 bp, Artificial Sequence
  dgRNA
  2310030G06Rik
gggaatcattccacc

SEQ ID NO: 83505 - DNA, 15 bp, Artificial Sequence
  dgRNA
  Tecpr1
cgcggagtcctgaga

SEQ ID NO: 83506 - DNA, 15 bp, Artificial Sequence
  dgRNA
  Tecpr1
gcggagtcctgagag

SEQ ID NO: 83507 - DNA, 15 bp, Artificial Sequence
  dgRNA
  Tecpr1
agcacagagcgccgc

SEQ ID NO: 83508 - DNA, 15 bp, Artificial Sequence
  dgRNA
  Tecpr1
agcgccgctggctag

SEQ ID NO: 83509 - DNA, 15 bp, Artificial Sequence
  dgRNA
  R3hcc1
gtcatatcacctttt

SEQ ID NO: 83510 - DNA, 15 bp, Artificial Sequence
  dgRNA
  R3hcc1
tcatatcaccttttt

SEQ ID NO: 83511 - DNA, 15 bp, Artificial Sequence
  dgRNA
  Klhl30
tcagcctaactgccc

SEQ ID NO: 83512 - DNA, 15 bp, Artificial Sequence
  dgRNA
  Klhl30
cgggcagttaggctg

SEQ ID NO: 83513 - DNA, 15 bp, Artificial Sequence
  dgRNA
  Klhl30
tcatcccgggcagtt

SEQ ID NO: 83514 - DNA, 15 bp, Artificial Sequence
  dgRNA
  Klhl30
gctttgattcatccc

SEQ ID NO: 83515 - DNA, 15 bp, Artificial Sequence
  dgRNA
  Bdnf
aagcagcgagctccg

SEQ ID NO: 83516 - DNA, 15 bp, Artificial Sequence
  dgRNA
  Bdnf
cagtgcaaggcgatc

SEQ ID NO: 83517 - DNA, 15 bp, Artificial Sequence
  dgRNA
  Bdnf
agtgcaaggcgatca

SEQ ID NO: 83518 - DNA, 15 bp, Artificial Sequence
  dgRNA
  Bdnf
atcagggataccccg

SEQ ID NO: 83519 - DNA, 15 bp, Artificial Sequence
  dgRNA
  Eea1
caacattcccgagca

SEQ ID NO: 83520 - DNA, 15 bp, Artificial Sequence
  dgRNA
  Eea1
ttcccgagcagggtc

SEQ ID NO: 83521 - DNA, 15 bp, Artificial Sequence
  dgRNA
  Eea1
agggtccggcaccca

SEQ ID NO: 83522 - DNA, 15 bp, Artificial Sequence
  dgRNA
  Eea1
ggtccaagctctcgg

SEQ ID NO: 83523 - DNA, 15 bp, Artificial Sequence
  dgRNA
  Herc3
tagatcccgaagcag

SEQ ID NO: 83524 - DNA, 15 bp, Artificial Sequence
  dgRNA
  Herc3
atcccgaagcagagg

SEQ ID NO: 83525 - DNA, 15 bp, Artificial Sequence
  dgRNA
  Herc3
ccttagtgtatggtg

SEQ ID NO: 83526 - DNA, 15 bp, Artificial Sequence
  dgRNA
  Herc3
gggtgagttaacgta

SEQ ID NO: 83527 - DNA, 15 bp, Artificial Sequence
  dgRNA
  Dtnb
cgcggagcgcagagc

SEQ ID NO: 83528 - DNA, 15 bp, Artificial Sequence
  dgRNA
  Dtnb
catcctgagcccggc

SEQ ID NO: 83529 - DNA, 15 bp, Artificial Sequence
  dgRNA
  Dtnb
tgagcccggctggcg

SEQ ID NO: 83530 - DNA, 15 bp, Artificial Sequence
  dgRNA
  Dtnb
aggaggctccgcgtt

SEQ ID NO: 83531 - DNA, 15 bp, Artificial Sequence
  dgRNA
  Foxp2
ctgcccgcccctcat

SEQ ID NO: 83532 - DNA, 15 bp, Artificial Sequence
  dgRNA
  Foxp2
actcgcgcgcgcgcc

SEQ ID NO: 83533 - DNA, 15 bp, Artificial Sequence
  dgRNA
  Foxp2
tactttgctaagttg

SEQ ID NO: 83534 - DNA, 15 bp, Artificial Sequence
  dgRNA
  Foxp2
tcttaagtactgttg

SEQ ID NO: 83535 - DNA, 15 bp, Artificial Sequence
  dgRNA
  Scyl2
gaagtgacgtcatgc

SEQ ID NO: 83536 - DNA, 15 bp, Artificial Sequence
  dgRNA
  Scyl2
gacgtcatgcaggag

SEQ ID NO: 83537 - DNA, 15 bp, Artificial Sequence
  dgRNA
  Scyl2
gacgtcacttccggg

SEQ ID NO: 83538 - DNA, 15 bp, Artificial Sequence
  dgRNA
  Scyl2
catgacgtcacttcc

SEQ ID NO: 83539 - DNA, 15 bp, Artificial Sequence
  dgRNA
  Olfr69
aactctatgtaagtt

SEQ ID NO: 83540 - DNA, 15 bp, Artificial Sequence
  dgRNA
  Chrm5
gcgctactctctgtt

SEQ ID NO: 83541 - DNA, 15 bp, Artificial Sequence
  dgRNA
  Chrm5
atttggtccaaggtt

SEQ ID NO: 83542 - DNA, 15 bp, Artificial Sequence
  dgRNA
  Chrm5
aattacactcagatt

SEQ ID NO: 83543 - DNA, 15 bp, Artificial Sequence
  dgRNA
  Vmn1r201
caatgaactatggtc

SEQ ID NO: 83544 - DNA, 15 bp, Artificial Sequence
  dgRNA
  Vmn1r201
ttctgatcgaaacaa

SEQ ID NO: 83545 - DNA, 15 bp, Artificial Sequence
  dgRNA
  Vmn2r83
gctaccaaactctca

SEQ ID NO: 83546 - DNA, 15 bp, Artificial Sequence
  dgRNA
  Vmn2r83
caaactctcaagggg

SEQ ID NO: 83547 - DNA, 15 bp, Artificial Sequence
  dgRNA
  Vmn2r83
ttcaggctctccatc

SEQ ID NO: 83548 - DNA, 15 bp, Artificial Sequence
  dgRNA
  Vmn2r83
caccccttgagagtt

SEQ ID NO: 83549 - DNA, 15 bp, Artificial Sequence
  dgRNA
  Rnf39
ccacagcgcatgccc

SEQ ID NO: 83550 - DNA, 15 bp, Artificial Sequence
  dgRNA
  Rnf39
gccccaaaccctact

SEQ ID NO: 83551 - DNA, 15 bp, Artificial Sequence
  dgRNA
  Rnf39
ccccaaaccctacta

SEQ ID NO: 83552 - DNA, 15 bp, Artificial Sequence
  dgRNA
  Rnf39
ccctactagggaagc

SEQ ID NO: 83553 - DNA, 15 bp, Artificial Sequence
  dgRNA
  Casp14
ctcaggtaggccggg

SEQ ID NO: 83554 - DNA, 15 bp, Artificial Sequence
  dgRNA
  Casp14
cgttcattcattcca

SEQ ID NO: 83555 - DNA, 15 bp, Artificial Sequence
  dgRNA
  Casp14
ctacacctgccgcca

SEQ ID NO: 83556 - DNA, 15 bp, Artificial Sequence
  dgRNA
  Casp14
tacacctgccgccaa

SEQ ID NO: 83557 - DNA, 15 bp, Artificial Sequence
  dgRNA
  Vps11
accgcctctctgtgg

SEQ ID NO: 83558 - DNA, 15 bp, Artificial Sequence
  dgRNA
  Vps11
acatgactcgccttt

SEQ ID NO: 83559 - DNA, 15 bp, Artificial Sequence
  dgRNA
  Vps11
tggtggcgcgattcg

SEQ ID NO: 83560 - DNA, 15 bp, Artificial Sequence
  dgRNA
  Vps11
cgtccttcaagagag

SEQ ID NO: 83561 - DNA, 15 bp, Artificial Sequence
  dgRNA
  Usp29
cagcgtctgcagcaa

SEQ ID NO: 83562 - DNA, 15 bp, Artificial Sequence
  dgRNA
  Usp29
ggacacctccttgtc

SEQ ID NO: 83563 - DNA, 15 bp, Artificial Sequence
  dgRNA
  Usp29
gacacctccttgtca

SEQ ID NO: 83564 - DNA, 15 bp, Artificial Sequence
  dgRNA
  Usp29
ccccattccccgctt

SEQ ID NO: 83565 - DNA, 15 bp, Artificial Sequence
  dgRNA
  Zc3hc1
gagcctaaacacgcg

SEQ ID NO: 83566 - DNA, 15 bp, Artificial Sequence
  dgRNA
  Zc3hc1
agcctaaacacgcga

SEQ ID NO: 83567 - DNA, 15 bp, Artificial Sequence
  dgRNA
  Zc3hc1
tcccctcgcgtgttt

SEQ ID NO: 83568 - DNA, 15 bp, Artificial Sequence
  dgRNA
  Gm13741
gggaattagctatgt

SEQ ID NO: 83569 - DNA, 15 bp, Artificial Sequence
  dgRNA
  Gm13741
aaggcttaggcactc

SEQ ID NO: 83570 - DNA, 15 bp, Artificial Sequence
  dgRNA
  Gm13741
tgagtgcctaagcct

SEQ ID NO: 83571 - DNA, 15 bp, Artificial Sequence
  dgRNA
  Ccl17
cgagtgaccattctc

SEQ ID NO: 83572 - DNA, 15 bp, Artificial Sequence
  dgRNA
  Ccl17
tgaatttctctagtc

SEQ ID NO: 83573 - DNA, 15 bp, Artificial Sequence
  dgRNA
  Ccl17
attataggaggggac

SEQ ID NO: 83574 - DNA, 15 bp, Artificial Sequence
  dgRNA
  Ccl17
ggataacctccagag

SEQ ID NO: 83575 - DNA, 15 bp, Artificial Sequence
  dgRNA
  Bdnf
tggtgtaatgctatc

SEQ ID NO: 83576 - DNA, 15 bp, Artificial Sequence
  dgRNA
  Bdnf
ggtgtaatgctatcc

SEQ ID NO: 83577 - DNA, 15 bp, Artificial Sequence
  dgRNA
  Bdnf
gtgtaatgctatccg

SEQ ID NO: 83578 - DNA, 15 bp, Artificial Sequence
  dgRNA
  Bdnf
ctattaggcacactc

SEQ ID NO: 83579 - DNA, 15 bp, Artificial Sequence
  dgRNA
  Tchp
acccatcatcctgac

SEQ ID NO: 83580 - DNA, 15 bp, Artificial Sequence
  dgRNA
  Tchp
ccttaccctacatca

SEQ ID NO: 83581 - DNA, 15 bp, Artificial Sequence
  dgRNA
  Tchp
ttacctcccaccgcc

SEQ ID NO: 83582 - DNA, 15 bp, Artificial Sequence
  dgRNA
  Tchp
atgagaatcatcccc

SEQ ID NO: 83583 - DNA, 15 bp, Artificial Sequence
  dgRNA
  Slitrk6
accgtttgcagaaat

SEQ ID NO: 83584 - DNA, 15 bp, Artificial Sequence
  dgRNA
  Slitrk6
taaagcacttctgat

SEQ ID NO: 83585 - DNA, 15 bp, Artificial Sequence
  dgRNA
  Slitrk6
ggaaatgattgcacg

SEQ ID NO: 83586 - DNA, 15 bp, Artificial Sequence
  dgRNA
  Slitrk6
agtgtcatataacac

SEQ ID NO: 83587 - DNA, 15 bp, Artificial Sequence
  dgRNA
  Cd36
atctcctagtaggcg

SEQ ID NO: 83588 - DNA, 15 bp, Artificial Sequence
  dgRNA
  Cd36
tctcctagtaggcgt

SEQ ID NO: 83589 - DNA, 15 bp, Artificial Sequence
  dgRNA
  Cd36
aggactggaatgctc

SEQ ID NO: 83590 - DNA, 15 bp, Artificial Sequence
  dgRNA
  Cd36
tcagctgctccgctg

SEQ ID NO: 83591 - DNA, 15 bp, Artificial Sequence
  dgRNA
  Ugt2b35
ccaccaacttcaatc

SEQ ID NO: 83592 - DNA, 15 bp, Artificial Sequence
  dgRNA
  Ugt2b35
ttatattttaactcg

SEQ ID NO: 83593 - DNA, 15 bp, Artificial Sequence
  dgRNA
  Ugt2b35
ccagattgaagttgg

SEQ ID NO: 83594 - DNA, 15 bp, Artificial Sequence
  dgRNA
  Med13
agggacgcgcgtccg

SEQ ID NO: 83595 - DNA, 15 bp, Artificial Sequence
  dgRNA
  Med13
gggacgcgcgtccgc

SEQ ID NO: 83596 - DNA, 15 bp, Artificial Sequence
  dgRNA
  Med13
cgggctccgcagtcc

SEQ ID NO: 83597 - DNA, 15 bp, Artificial Sequence
  dgRNA
  Med13
gctccgcagtcccgg

SEQ ID NO: 83598 - DNA, 15 bp, Artificial Sequence
  dgRNA
  Aak1
ccacggccggattcc

SEQ ID NO: 83599 - DNA, 15 bp, Artificial Sequence
  dgRNA
  Aak1
cacggccggattccc

SEQ ID NO: 83600 - DNA, 15 bp, Artificial Sequence
  dgRNA
  Aak1
acggccggattcccg

SEQ ID NO: 83601 - DNA, 15 bp, Artificial Sequence
  dgRNA
  Aak1
ccggggctctgctca

SEQ ID NO: 83602 - DNA, 15 bp, Artificial Sequence
  dgRNA
  __NTC
tatagcgtcgcgcgc

SEQ ID NO: 83603 - DNA, 15 bp, Artificial Sequence
  dgRNA
  __NTC
cgcgtaaccgttccg

SEQ ID NO: 83604 - DNA, 15 bp, Artificial Sequence
  dgRNA
  __NTC
ttatgtcgcgccgcg

SEQ ID NO: 83605 - DNA, 15 bp, Artificial Sequence
  dgRNA
  __NTC
tcgacgcgagacgac

SEQ ID NO: 83606 - DNA, 15 bp, Artificial Sequence
  dgRNA
  __NTC
atacccgtcgcgaac

SEQ ID NO: 83607 - DNA, 15 bp, Artificial Sequence
  dgRNA
  __NTC
gcttacgcgtcgcga

SEQ ID NO: 83608 - DNA, 15 bp, Artificial Sequence
  dgRNA
  __NTC
cgaatcgcgcctacg

SEQ ID NO: 83609 - DNA, 15 bp, Artificial Sequence
  dgRNA
  __NTC
cgccgaacggataag

SEQ ID NO: 83610 - DNA, 15 bp, Artificial Sequence
  dgRNA
  __NTC
cgaccgaggttacgc

SEQ ID NO: 83611 - DNA, 15 bp, Artificial Sequence
  dgRNA
  __NTC
atcgccgtacggcta

SEQ ID NO: 83612 - DNA, 15 bp, Artificial Sequence
  dgRNA
  __NTC
cgctaagttcgcgcg

SEQ ID NO: 83613 - DNA, 15 bp, Artificial Sequence
  dgRNA
  __NTC
cgttcgtcgacgaag

SEQ ID NO: 83614 - DNA, 15 bp, Artificial Sequence
  dgRNA
  __NTC
cgccgacgattaatc

SEQ ID NO: 83615 - DNA, 15 bp, Artificial Sequence
  dgRNA
  __NTC
gaccgttgtatcgcg

SEQ ID NO: 83616 - DNA, 15 bp, Artificial Sequence
  dgRNA
  __NTC
ccgttcgtgcgatag

SEQ ID NO: 83617 - DNA, 15 bp, Artificial Sequence
  dgRNA
  __NTC
gttgtcgtgccgcga

SEQ ID NO: 83618 - DNA, 15 bp, Artificial Sequence
  dgRNA
  __NTC
cggtacgttagacga

SEQ ID NO: 83619 - DNA, 15 bp, Artificial Sequence
  dgRNA
  __NTC
tatcgaacgctatcg

SEQ ID NO: 83620 - DNA, 15 bp, Artificial Sequence
  dgRNA
  __NTC
tccggttacgaccgg

SEQ ID NO: 83621 - DNA, 15 bp, Artificial Sequence
  dgRNA
  __NTC
cgtcgtagaacgata

SEQ ID NO: 83622 - DNA, 15 bp, Artificial Sequence
  dgRNA
  __NTC
attccggcgcgacca

SEQ ID NO: 83623 - DNA, 15 bp, Artificial Sequence
  dgRNA
  __NTC
gtataacttcgcgcg

SEQ ID NO: 83624 - DNA, 15 bp, Artificial Sequence
  dgRNA
  __NTC
gcgcgtcaacgtaat

SEQ ID NO: 83625 - DNA, 15 bp, Artificial Sequence
  dgRNA
  __NTC
acgcgctattatcgt

SEQ ID NO: 83626 - DNA, 15 bp, Artificial Sequence
  dgRNA
  __NTC
actatcgacgttcgt

SEQ ID NO: 83627 - DNA, 15 bp, Artificial Sequence
  dgRNA
  __NTC
tcgcgttatcgtgcc

SEQ ID NO: 83628 - DNA, 15 bp, Artificial Sequence
  dgRNA
  __NTC
cgcgacggcggtttt

SEQ ID NO: 83629 - DNA, 15 bp, Artificial Sequence
  dgRNA
  __NTC
gtcgcgttgcgaccg

SEQ ID NO: 83630 - DNA, 15 bp, Artificial Sequence
  dgRNA
  __NTC
accgctaatcggcgt

SEQ ID NO: 83631 - DNA, 15 bp, Artificial Sequence
  dgRNA
  __NTC
cgcgatctataccgt

SEQ ID NO: 83632 - DNA, 15 bp, Artificial Sequence
  dgRNA
  __NTC
cgatcgtacgggtgt

SEQ ID NO: 83633 - DNA, 15 bp, Artificial Sequence
  dgRNA
  __NTC
gccgaccgcgtgatt

SEQ ID NO: 83634 - DNA, 15 bp, Artificial Sequence
  dgRNA
  __NTC
gcacgttacgcccgg

SEQ ID NO: 83635 - DNA, 15 bp, Artificial Sequence
  dgRNA
  __NTC
taagcgaccgacgca

SEQ ID NO: 83636 - DNA, 15 bp, Artificial Sequence
  dgRNA
  __NTC
tagcgttcgacacgt

SEQ ID NO: 83637 - DNA, 15 bp, Artificial Sequence
  dgRNA
  __NTC
tggcgcgtaatcgct

SEQ ID NO: 83638 - DNA, 15 bp, Artificial Sequence
  dgRNA
  __NTC
caacccgccgtagcg

SEQ ID NO: 83639 - DNA, 15 bp, Artificial Sequence
  dgRNA
  __NTC
tttgcgttgacgcga

SEQ ID NO: 83640 - DNA, 15 bp, Artificial Sequence
  dgRNA
  __NTC
aacggagcgcgatac

SEQ ID NO: 83641 - DNA, 15 bp, Artificial Sequence
  dgRNA
  __NTC
ccggacgttataacg

SEQ ID NO: 83642 - DNA, 15 bp, Artificial Sequence
  dgRNA
  __NTC
attcgcgaacccggc

SEQ ID NO: 83643 - DNA, 15 bp, Artificial Sequence
  dgRNA
  __NTC
ttgatggcgcgacgc

SEQ ID NO: 83644 - DNA, 15 bp, Artificial Sequence
  dgRNA
  __NTC
ggtcaaatcgcggcg

SEQ ID NO: 83645 - DNA, 15 bp, Artificial Sequence
  dgRNA
  __NTC
cgactcgcgcattga

SEQ ID NO: 83646 - DNA, 15 bp, Artificial Sequence
  dgRNA
  __NTC
agcgtcgtacgattt

SEQ ID NO: 83647 - DNA, 15 bp, Artificial Sequence
  dgRNA
  __NTC
cggaacgcgtgatac

SEQ ID NO: 83648 - DNA, 15 bp, Artificial Sequence
  dgRNA
  __NTC
agcgggtcgtagacg

SEQ ID NO: 83649 - DNA, 15 bp, Artificial Sequence
  dgRNA
  __NTC
tctcgtatcgcgatt

SEQ ID NO: 83650 - DNA, 15 bp, Artificial Sequence
  dgRNA
  __NTC
cggtcgactacggct

SEQ ID NO: 83651 - DNA, 15 bp, Artificial Sequence
  dgRNA
  __NTC
tcggggcgcgtcaac

SEQ ID NO: 83652 - DNA, 15 bp, Artificial Sequence
  dgRNA
  __NTC
attgccgctcgcgca

SEQ ID NO: 83653 - DNA, 15 bp, Artificial Sequence
  dgRNA
  __NTC
taacgcgcaacacgc

SEQ ID NO: 83654 - DNA, 15 bp, Artificial Sequence
  dgRNA
  __NTC
gtatcggatgcgtcg

SEQ ID NO: 83655 - DNA, 15 bp, Artificial Sequence
  dgRNA
  __NTC
acgttgcgtatgcga

SEQ ID NO: 83656 - DNA, 15 bp, Artificial Sequence
  dgRNA
  __NTC
catttcgaccgtcgc

SEQ ID NO: 83657 - DNA, 15 bp, Artificial Sequence
  dgRNA
  __NTC
cgcgatcacggttgg

SEQ ID NO: 83658 - DNA, 15 bp, Artificial Sequence
  dgRNA
  __NTC
acgttgcgcgttgac

SEQ ID NO: 83659 - DNA, 15 bp, Artificial Sequence
  dgRNA
  __NTC
ccgttacgttgcgca

SEQ ID NO: 83660 - DNA, 15 bp, Artificial Sequence
  dgRNA
  __NTC
tcgccgcaagacgcc

SEQ ID NO: 83661 - DNA, 15 bp, Artificial Sequence
  dgRNA
  __NTC
gacgcctacggtacg

SEQ ID NO: 83662 - DNA, 15 bp, Artificial Sequence
  dgRNA
  __NTC
acgcgtcggtaatgc

SEQ ID NO: 83663 - DNA, 15 bp, Artificial Sequence
  dgRNA
  __NTC
atgcgttgtcgcgta

SEQ ID NO: 83664 - DNA, 15 bp, Artificial Sequence
  dgRNA
  __NTC
actgcgcgacgaata

SEQ ID NO: 83665 - DNA, 15 bp, Artificial Sequence
  dgRNA
  __NTC
cgtccgatcgatctg

SEQ ID NO: 83666 - DNA, 15 bp, Artificial Sequence
  dgRNA
  __NTC
tcgccgttcacgata

SEQ ID NO: 83667 - DNA, 15 bp, Artificial Sequence
  dgRNA
  __NTC
tgagtgcgacgatcg

SEQ ID NO: 83668 - DNA, 15 bp, Artificial Sequence
  dgRNA
  __NTC
gatccagtacgcgcg

SEQ ID NO: 83669 - DNA, 15 bp, Artificial Sequence
  dgRNA
  __NTC
ggcgcgctagtataa

SEQ ID NO: 83670 - DNA, 15 bp, Artificial Sequence
  dgRNA
  __NTC
gtaaaccgtcggacg

SEQ ID NO: 83671 - DNA, 15 bp, Artificial Sequence
  dgRNA
  __NTC
cgcgcaccatcgaac

SEQ ID NO: 83672 - DNA, 15 bp, Artificial Sequence
  dgRNA
  __NTC
accttcgtcgaacgt

SEQ ID NO: 83673 - DNA, 15 bp, Artificial Sequence
  dgRNA
  __NTC
cgagcgcatttacgg

SEQ ID NO: 83674 - DNA, 15 bp, Artificial Sequence
  dgRNA
  __NTC
gccgcgtataactcg

SEQ ID NO: 83675 - DNA, 15 bp, Artificial Sequence
  dgRNA
  __NTC
acgcgcgtagaacct

SEQ ID NO: 83676 - DNA, 15 bp, Artificial Sequence
  dgRNA
  __NTC
aaccgcgcgtaatgt

SEQ ID NO: 83677 - DNA, 15 bp, Artificial Sequence
  dgRNA
  __NTC
acgataccgcgtatc

SEQ ID NO: 83678 - DNA, 15 bp, Artificial Sequence
  dgRNA
  __NTC
cgatctcgacgagag

SEQ ID NO: 83679 - DNA, 15 bp, Artificial Sequence
  dgRNA
  __NTC
agctacgacgcgtat

SEQ ID NO: 83680 - DNA, 15 bp, Artificial Sequence
  dgRNA
  __NTC
cgtggccggtcgatt

SEQ ID NO: 83681 - DNA, 15 bp, Artificial Sequence
  dgRNA
  __NTC
tcggtacgtcggcct

SEQ ID NO: 83682 - DNA, 15 bp, Artificial Sequence
  dgRNA
  __NTC
cacgttgcacgaccg

SEQ ID NO: 83683 - DNA, 15 bp, Artificial Sequence
  dgRNA
  __NTC
cgtcgatagggacgt

SEQ ID NO: 83684 - DNA, 15 bp, Artificial Sequence
  dgRNA
  __NTC
aaccgccgtgtacgc

SEQ ID NO: 83685 - DNA, 15 bp, Artificial Sequence
  dgRNA
  __NTC
acgggcgggtcgata

SEQ ID NO: 83686 - DNA, 15 bp, Artificial Sequence
  dgRNA
  __NTC
gagtaccgacccgcg

SEQ ID NO: 83687 - DNA, 15 bp, Artificial Sequence
  dgRNA
  __NTC
tacgtgacgcgaata

SEQ ID NO: 83688 - DNA, 15 bp, Artificial Sequence
  dgRNA
  __NTC
tcgccggacgctcta

SEQ ID NO: 83689 - DNA, 15 bp, Artificial Sequence
  dgRNA
  __NTC
cgctacttatagcgc

SEQ ID NO: 83690 - DNA, 15 bp, Artificial Sequence
  dgRNA
  __NTC
gtctcgcgatcgtca

SEQ ID NO: 83691 - DNA, 15 bp, Artificial Sequence
  dgRNA
  __NTC
aatggacgcgcgatc

SEQ ID NO: 83692 - DNA, 15 bp, Artificial Sequence
  dgRNA
  __NTC
cacgccttacggacg

SEQ ID NO: 83693 - DNA, 15 bp, Artificial Sequence
  dgRNA
  __NTC
acggcgcatgtcgtg

SEQ ID NO: 83694 - DNA, 15 bp, Artificial Sequence
  dgRNA
  __NTC
aaccgaacgatcacg

SEQ ID NO: 83695 - DNA, 15 bp, Artificial Sequence
  dgRNA
  __NTC
tgacgaccgcacgcg

SEQ ID NO: 83696 - DNA, 15 bp, Artificial Sequence
  dgRNA
  __NTC
tcccgtacgttcgaa

SEQ ID NO: 83697 - DNA, 15 bp, Artificial Sequence
  dgRNA
  __NTC
ggcgcgtgtatcgtt

SEQ ID NO: 83698 - DNA, 15 bp, Artificial Sequence
  dgRNA
  __NTC
cgggtacgaccgggc

SEQ ID NO: 83699 - DNA, 15 bp, Artificial Sequence
  dgRNA
  __NTC
cgcgacgttgtgcat

SEQ ID NO: 83700 - DNA, 15 bp, Artificial Sequence
  dgRNA
  __NTC
tccccgatcggccgt

SEQ ID NO: 83701 - DNA, 15 bp, Artificial Sequence
  dgRNA
  __NTC
tcgcggcggttcatg

SEQ ID NO: 83702 - DNA, 15 bp, Artificial Sequence
  dgRNA
  __NTC
tcgggtagcggcgaa

SEQ ID NO: 83703 - DNA, 15 bp, Artificial Sequence
  dgRNA
  __NTC
agattccgttcgcgt

SEQ ID NO: 83704 - DNA, 15 bp, Artificial Sequence
  dgRNA
  __NTC
gcgaccgtcggtatc

SEQ ID NO: 83705 - DNA, 15 bp, Artificial Sequence
  dgRNA
  __NTC
ttgttccgatcgacg

SEQ ID NO: 83706 - DNA, 15 bp, Artificial Sequence
  dgRNA
  __NTC
cgcgttcgaaatagt

SEQ ID NO: 83707 - DNA, 15 bp, Artificial Sequence
  dgRNA
  __NTC
cgcgctacgggtgtc

SEQ ID NO: 83708 - DNA, 15 bp, Artificial Sequence
  dgRNA
  __NTC
ccgccgtggatcgat

SEQ ID NO: 83709 - DNA, 15 bp, Artificial Sequence
  dgRNA
  __NTC
cgcaatagaagcgcg

SEQ ID NO: 83710 - DNA, 15 bp, Artificial Sequence
  dgRNA
  __NTC
cgacttgcgtccgtt

SEQ ID NO: 83711 - DNA, 15 bp, Artificial Sequence
  dgRNA
  __NTC
cgagcgctagacgga

SEQ ID NO: 83712 - DNA, 15 bp, Artificial Sequence
  dgRNA
  __NTC
cggcgcttttgtcga

SEQ ID NO: 83713 - DNA, 15 bp, Artificial Sequence
  dgRNA
  __NTC
accctatatcgcgtc

SEQ ID NO: 83714 - DNA, 15 bp, Artificial Sequence
  dgRNA
  __NTC
cgaccgacgcaacct

SEQ ID NO: 83715 - DNA, 15 bp, Artificial Sequence
  dgRNA
  __NTC
gattgtgccgcgcga

SEQ ID NO: 83716 - DNA, 15 bp, Artificial Sequence
  dgRNA
  __NTC
cgacgtacgttcctc

SEQ ID NO: 83717 - DNA, 15 bp, Artificial Sequence
  dgRNA
  __NTC
tagacgcacgtacga

SEQ ID NO: 83718 - DNA, 15 bp, Artificial Sequence
  dgRNA
  __NTC
tcgcacgccgatcaa

SEQ ID NO: 83719 - DNA, 15 bp, Artificial Sequence
  dgRNA
  __NTC
acgtacacgcccgtt

SEQ ID NO: 83720 - DNA, 15 bp, Artificial Sequence
  dgRNA
  __NTC
tcgcggtcggacaag

SEQ ID NO: 83721 - DNA, 15 bp, Artificial Sequence
  dgRNA
  __NTC
cgttgccgacggtct

SEQ ID NO: 83722 - DNA, 15 bp, Artificial Sequence
  dgRNA
  __NTC
cggcaaggtaacgcg

SEQ ID NO: 83723 - DNA, 15 bp, Artificial Sequence
  dgRNA
  __NTC
ccggcgcgcttgtaa

SEQ ID NO: 83724 - DNA, 15 bp, Artificial Sequence
  dgRNA
  __NTC
cgggtacggcgacaa

SEQ ID NO: 83725 - DNA, 15 bp, Artificial Sequence
  dgRNA
  __NTC
gcgcgccatcgaaac

SEQ ID NO: 83726 - DNA, 15 bp, Artificial Sequence
  dgRNA
  __NTC
ctcgtaatcgtccgg

SEQ ID NO: 83727 - DNA, 15 bp, Artificial Sequence
  dgRNA
  __NTC
acgatcgcttcgatt

SEQ ID NO: 83728 - DNA, 15 bp, Artificial Sequence
  dgRNA
  __NTC
gaccgcggcgcaaca

SEQ ID NO: 83729 - DNA, 15 bp, Artificial Sequence
  dgRNA
  __NTC
cgcggactcgtaatt

SEQ ID NO: 83730 - DNA, 15 bp, Artificial Sequence
  dgRNA
  __NTC
cgcactttgacgacg

SEQ ID NO: 83731 - DNA, 15 bp, Artificial Sequence
  dgRNA
  __NTC
gtataacgatcgggt

SEQ ID NO: 83732 - DNA, 15 bp, Artificial Sequence
  dgRNA
  __NTC
cgtagacggggcgtc

SEQ ID NO: 83733 - DNA, 15 bp, Artificial Sequence
  dgRNA
  __NTC
gaatcgtcggacggt

SEQ ID NO: 83734 - DNA, 15 bp, Artificial Sequence
  dgRNA
  __NTC
cgcatactcggcgga

SEQ ID NO: 83735 - DNA, 15 bp, Artificial Sequence
  dgRNA
  __NTC
ctcgaagcgcgattc

SEQ ID NO: 83736 - DNA, 15 bp, Artificial Sequence
  dgRNA
  __NTC
ctccgtcgatcaccg

SEQ ID NO: 83737 - DNA, 15 bp, Artificial Sequence
  dgRNA
  __NTC
agtgcgccgaacacg

SEQ ID NO: 83738 - DNA, 15 bp, Artificial Sequence
  dgRNA
  __NTC
cgctcggtaccgttg

SEQ ID NO: 83739 - DNA, 15 bp, Artificial Sequence
  dgRNA
  __NTC
atcacggcgatacgc

SEQ ID NO: 83740 - DNA, 15 bp, Artificial Sequence
  dgRNA
  __NTC
ttacgaagcccgcga

SEQ ID NO: 83741 - DNA, 15 bp, Artificial Sequence
  dgRNA
  __NTC
tacaacggtccgatc

SEQ ID NO: 83742 - DNA, 15 bp, Artificial Sequence
  dgRNA
  __NTC
cctccgcggacgtat

SEQ ID NO: 83743 - DNA, 15 bp, Artificial Sequence
  dgRNA
  __NTC
cgatcgtcggccaca

SEQ ID NO: 83744 - DNA, 15 bp, Artificial Sequence
  dgRNA
  __NTC
ctcgtaccgaaggcg

SEQ ID NO: 83745 - DNA, 15 bp, Artificial Sequence
  dgRNA
  __NTC
ctcacggcgatcgta

SEQ ID NO: 83746 - DNA, 15 bp, Artificial Sequence
  dgRNA
  __NTC
tcgttcgggcgcttg

SEQ ID NO: 83747 - DNA, 15 bp, Artificial Sequence
  dgRNA
  __NTC
gcgaactagtagacg

SEQ ID NO: 83748 - DNA, 15 bp, Artificial Sequence
  dgRNA
  __NTC
ggctagcgcgcttcg

SEQ ID NO: 83749 - DNA, 15 bp, Artificial Sequence
  dgRNA
  __NTC
cgcgagtacgacaag

SEQ ID NO: 83750 - DNA, 15 bp, Artificial Sequence
  dgRNA
  __NTC
gtcgtctagcgccta

SEQ ID NO: 83751 - DNA, 15 bp, Artificial Sequence
  dgRNA
  __NTC
cgaactcgggcgcga

SEQ ID NO: 83752 - DNA, 15 bp, Artificial Sequence
  dgRNA
  __NTC
accgaagattccgcg

SEQ ID NO: 83753 - DNA, 15 bp, Artificial Sequence
  dgRNA
  __NTC
cacggcgtatgtacg

SEQ ID NO: 83754 - DNA, 15 bp, Artificial Sequence
  dgRNA
  __NTC
ataagcgtaaccgcc

SEQ ID NO: 83755 - DNA, 15 bp, Artificial Sequence
  dgRNA
  __NTC
aacgtcgtctcgtat

SEQ ID NO: 83756 - DNA, 15 bp, Artificial Sequence
  dgRNA
  __NTC
ctggcgcgattcgag

SEQ ID NO: 83757 - DNA, 15 bp, Artificial Sequence
  dgRNA
  __NTC
tagcggccagtcgcg

SEQ ID NO: 83758 - DNA, 15 bp, Artificial Sequence
  dgRNA
  __NTC
cggctcgactagttc

SEQ ID NO: 83759 - DNA, 15 bp, Artificial Sequence
  dgRNA
  __NTC
ggatccgtcgcgact

SEQ ID NO: 83760 - DNA, 15 bp, Artificial Sequence
  dgRNA
  __NTC
gatacgcgacgtgaa

SEQ ID NO: 83761 - DNA, 15 bp, Artificial Sequence
  dgRNA
  __NTC
caatgacgtcgagcg

SEQ ID NO: 83762 - DNA, 15 bp, Artificial Sequence
  dgRNA
  __NTC
acatacgcccgagcg

SEQ ID NO: 83763 - DNA, 15 bp, Artificial Sequence
  dgRNA
  __NTC
tgtcgcggtcggcgc

SEQ ID NO: 83764 - DNA, 15 bp, Artificial Sequence
  dgRNA
  __NTC
cggccacccgttcga

SEQ ID NO: 83765 - DNA, 15 bp, Artificial Sequence
  dgRNA
  __NTC
ggtcgtctagcgaat

SEQ ID NO: 83766 - DNA, 15 bp, Artificial Sequence
  dgRNA
  __NTC
acccaacgcgggcgt

SEQ ID NO: 83767 - DNA, 15 bp, Artificial Sequence
  dgRNA
  __NTC
aactccggcgagcgt

SEQ ID NO: 83768 - DNA, 15 bp, Artificial Sequence
  dgRNA
  __NTC
tcccgcggtttcgta

SEQ ID NO: 83769 - DNA, 15 bp, Artificial Sequence
  dgRNA
  __NTC
cgttgccgaccagcg

SEQ ID NO: 83770 - DNA, 15 bp, Artificial Sequence
  dgRNA
  __NTC
ctccgtatccgcgcg

SEQ ID NO: 83771 - DNA, 15 bp, Artificial Sequence
  dgRNA
  __NTC
cccgcgcttttacgg

SEQ ID NO: 83772 - DNA, 15 bp, Artificial Sequence
  dgRNA
  __NTC
gtataccgcgagtta

SEQ ID NO: 83773 - DNA, 15 bp, Artificial Sequence
  dgRNA
  __NTC
gtcccgtgcgcggtt

SEQ ID NO: 83774 - DNA, 15 bp, Artificial Sequence
  dgRNA
  __NTC
tcgccgtaaataccg

SEQ ID NO: 83775 - DNA, 15 bp, Artificial Sequence
  dgRNA
  __NTC
aagcgtacgcagacg

SEQ ID NO: 83776 - DNA, 15 bp, Artificial Sequence
  dgRNA
  __NTC
cgacgggcggtcagt

SEQ ID NO: 83777 - DNA, 15 bp, Artificial Sequence
  dgRNA
  __NTC
gagcgcgaatcggcc

SEQ ID NO: 83778 - DNA, 15 bp, Artificial Sequence
  dgRNA
  __NTC
acccgggcgttcgac

SEQ ID NO: 83779 - DNA, 15 bp, Artificial Sequence
  dgRNA
  __NTC
agcacgacttcggcg

SEQ ID NO: 83780 - DNA, 15 bp, Artificial Sequence
  dgRNA
  __NTC
cgtaagccgtttcgt

SEQ ID NO: 83781 - DNA, 15 bp, Artificial Sequence
  dgRNA
  __NTC
cgcgccgcaatcact

SEQ ID NO: 83782 - DNA, 15 bp, Artificial Sequence
  dgRNA
  __NTC
tatcggccaccggtc

SEQ ID NO: 83783 - DNA, 15 bp, Artificial Sequence
  dgRNA
  __NTC
atagcgcgccggcgc

SEQ ID NO: 83784 - DNA, 15 bp, Artificial Sequence
  dgRNA
  __NTC
gccgatactaggcgt

SEQ ID NO: 83785 - DNA, 15 bp, Artificial Sequence
  dgRNA
  __NTC
gccaacggtcgcgga

SEQ ID NO: 83786 - DNA, 15 bp, Artificial Sequence
  dgRNA
  __NTC
attgcggagcggcgt

SEQ ID NO: 83787 - DNA, 15 bp, Artificial Sequence
  dgRNA
  __NTC
ggggataccgcgtaa

SEQ ID NO: 83788 - DNA, 15 bp, Artificial Sequence
  dgRNA
  __NTC
ccgcgatgcgaaata

SEQ ID NO: 83789 - DNA, 15 bp, Artificial Sequence
  dgRNA
  __NTC
tacacccggtgcgcg

SEQ ID NO: 83790 - DNA, 15 bp, Artificial Sequence
  dgRNA
  __NTC
cggacaaccgctata

SEQ ID NO: 83791 - DNA, 15 bp, Artificial Sequence
  dgRNA
  __NTC
gattgcgcgcctatg

SEQ ID NO: 83792 - DNA, 15 bp, Artificial Sequence
  dgRNA
  __NTC
tcgcgacactgaccg

SEQ ID NO: 83793 - DNA, 15 bp, Artificial Sequence
  dgRNA
  __NTC
accggtagcgttatg

SEQ ID NO: 83794 - DNA, 15 bp, Artificial Sequence
  dgRNA
  __NTC
acgtaattgcgccta

SEQ ID NO: 83795 - DNA, 15 bp, Artificial Sequence
  dgRNA
  __NTC
cggcctcgacacgaa

SEQ ID NO: 83796 - DNA, 15 bp, Artificial Sequence
  dgRNA
  __NTC
tgatgcgacgaaacg

SEQ ID NO: 83797 - DNA, 15 bp, Artificial Sequence
  dgRNA
  __NTC
ctcgcgcgttagctg

SEQ ID NO: 83798 - DNA, 15 bp, Artificial Sequence
  dgRNA
  __NTC
tggacacgcgacccg

SEQ ID NO: 83799 - DNA, 15 bp, Artificial Sequence
  dgRNA
  __NTC
aaagagtcgacgcga

SEQ ID NO: 83800 - DNA, 15 bp, Artificial Sequence
  dgRNA
  __NTC
acgctcgatcgatca

SEQ ID NO: 83801 - DNA, 15 bp, Artificial Sequence
  dgRNA
  __NTC
cggaatgatcgagcg

SEQ ID NO: 83802 - DNA, 15 bp, Artificial Sequence
  dgRNA
  __NTC
tccgacgcacgggtc

SEQ ID NO: 83803 - DNA, 15 bp, Artificial Sequence
  dgRNA
  __NTC
tcacgccgctcggtc

SEQ ID NO: 83804 - DNA, 15 bp, Artificial Sequence
  dgRNA
  __NTC
ggacggtcccgtcga

SEQ ID NO: 83805 - DNA, 15 bp, Artificial Sequence
  dgRNA
  __NTC
ccgtaccgaaacgta

SEQ ID NO: 83806 - DNA, 15 bp, Artificial Sequence
  dgRNA
  __NTC
gttgatactccgcgg

SEQ ID NO: 83807 - DNA, 15 bp, Artificial Sequence
  dgRNA
  __NTC
tccgagtccgtcgga

SEQ ID NO: 83808 - DNA, 15 bp, Artificial Sequence
  dgRNA
  __NTC
gtatagggtacgcga

SEQ ID NO: 83809 - DNA, 15 bp, Artificial Sequence
  dgRNA
  __NTC
ccgcgtcgaaataaa

SEQ ID NO: 83810 - DNA, 15 bp, Artificial Sequence
  dgRNA
  __NTC
cggtcacgcgagagt

SEQ ID NO: 83811 - DNA, 15 bp, Artificial Sequence
  dgRNA
  __NTC
atcagcgacgatacg

SEQ ID NO: 83812 - DNA, 15 bp, Artificial Sequence
  dgRNA
  __NTC
cgactaccgtcggga

SEQ ID NO: 83813 - DNA, 15 bp, Artificial Sequence
  dgRNA
  __NTC
tacgtcggcataccc

SEQ ID NO: 83814 - DNA, 15 bp, Artificial Sequence
  dgRNA
  __NTC
cgattttccgctcgt

SEQ ID NO: 83815 - DNA, 15 bp, Artificial Sequence
  dgRNA
  __NTC
tgggtactcgccgcg

SEQ ID NO: 83816 - DNA, 15 bp, Artificial Sequence
  dgRNA
  __NTC
gcgtgacgcatcgta

SEQ ID NO: 83817 - DNA, 15 bp, Artificial Sequence
  dgRNA
  __NTC
ggtgcgcacgtcgga

SEQ ID NO: 83818 - DNA, 15 bp, Artificial Sequence
  dgRNA
  __NTC
tacgtgcgttcgtta

SEQ ID NO: 83819 - DNA, 15 bp, Artificial Sequence
  dgRNA
  __NTC
cgaacgtcagacgta

SEQ ID NO: 83820 - DNA, 15 bp, Artificial Sequence
  dgRNA
  __NTC
cgcgcgtctggtatg

SEQ ID NO: 83821 - DNA, 15 bp, Artificial Sequence
  dgRNA
  __NTC
gcgtcggggataccg

SEQ ID NO: 83822 - DNA, 15 bp, Artificial Sequence
  dgRNA
  __NTC
ccacaataagtcgcg

SEQ ID NO: 83823 - DNA, 15 bp, Artificial Sequence
  dgRNA
  __NTC
actcacgagcgtcgc

SEQ ID NO: 83824 - DNA, 15 bp, Artificial Sequence
  dgRNA
  __NTC
acttcgccgaacgcc

SEQ ID NO: 83825 - DNA, 15 bp, Artificial Sequence
  dgRNA
  __NTC
ccacttctacgcgcg

SEQ ID NO: 83826 - DNA, 15 bp, Artificial Sequence
  dgRNA
  __NTC
attggcggtccgtaa

SEQ ID NO: 83827 - DNA, 15 bp, Artificial Sequence
  dgRNA
  __NTC
ttgggccgacgtact

SEQ ID NO: 83828 - DNA, 15 bp, Artificial Sequence
  dgRNA
  __NTC
ccgagcgggacggtt

SEQ ID NO: 83829 - DNA, 15 bp, Artificial Sequence
  dgRNA
  __NTC
cgtcgctttcacggc

SEQ ID NO: 83830 - DNA, 15 bp, Artificial Sequence
  dgRNA
  __NTC
atatgccggccgccg

SEQ ID NO: 83831 - DNA, 15 bp, Artificial Sequence
  dgRNA
  __NTC
cggacgccatcgaaa

SEQ ID NO: 83832 - DNA, 15 bp, Artificial Sequence
  dgRNA
  __NTC
tcgctagcgccccgt

SEQ ID NO: 83833 - DNA, 15 bp, Artificial Sequence
  dgRNA
  __NTC
cgagacgtcgaaaat

SEQ ID NO: 83834 - DNA, 15 bp, Artificial Sequence
  dgRNA
  __NTC
ctttcgcacggcgtg

SEQ ID NO: 83835 - DNA, 15 bp, Artificial Sequence
  dgRNA
  __NTC
tgcgccgtacagacg

SEQ ID NO: 83836 - DNA, 15 bp, Artificial Sequence
  dgRNA
  __NTC
tgcgtcggcgagcat

SEQ ID NO: 83837 - DNA, 15 bp, Artificial Sequence
  dgRNA
  __NTC
gcgatctaacgaccc

SEQ ID NO: 83838 - DNA, 15 bp, Artificial Sequence
  dgRNA
  __NTC
tagtacggcgcatta

SEQ ID NO: 83839 - DNA, 15 bp, Artificial Sequence
  dgRNA
  __NTC
aacgatgcgcacgcc

SEQ ID NO: 83840 - DNA, 15 bp, Artificial Sequence
  dgRNA
  __NTC
gcggtcggttgcaat

SEQ ID NO: 83841 - DNA, 15 bp, Artificial Sequence
  dgRNA
  __NTC
cgagtcgccagacgg

SEQ ID NO: 83842 - DNA, 15 bp, Artificial Sequence
  dgRNA
  __NTC
gcgctgttcgttcgg

SEQ ID NO: 83843 - DNA, 15 bp, Artificial Sequence
  dgRNA
  __NTC
cgtcgtggaacgttc

SEQ ID NO: 83844 - DNA, 15 bp, Artificial Sequence
  dgRNA
  __NTC
acgtattcggtcgca

SEQ ID NO: 83845 - DNA, 15 bp, Artificial Sequence
  dgRNA
  __NTC
tagtataggcgcgga

SEQ ID NO: 83846 - DNA, 15 bp, Artificial Sequence
  dgRNA
  __NTC
gctcgcggttagtag

SEQ ID NO: 83847 - DNA, 15 bp, Artificial Sequence
  dgRNA
  __NTC
cggtattgcgctcaa

SEQ ID NO: 83848 - DNA, 15 bp, Artificial Sequence
  dgRNA
  __NTC
tgttatcgagcgtac

SEQ ID NO: 83849 - DNA, 15 bp, Artificial Sequence
  dgRNA
  __NTC
gcgtattatgccggc

SEQ ID NO: 83850 - DNA, 15 bp, Artificial Sequence
  dgRNA
  __NTC
gcgtagggcggttat

SEQ ID NO: 83851 - DNA, 15 bp, Artificial Sequence
  dgRNA
  __NTC
ataccagcgatccgc

SEQ ID NO: 83852 - DNA, 15 bp, Artificial Sequence
  dgRNA
  __NTC
ctgccgtgctacgcg

SEQ ID NO: 83853 - DNA, 15 bp, Artificial Sequence
  dgRNA
  __NTC
gcgactagcggggtc

SEQ ID NO: 83854 - DNA, 15 bp, Artificial Sequence
  dgRNA
  __NTC
gcgtatatcaagccg

SEQ ID NO: 83855 - DNA, 15 bp, Artificial Sequence
  dgRNA
  __NTC
cggggcgatcgtgca

SEQ ID NO: 83856 - DNA, 15 bp, Artificial Sequence
  dgRNA
  __NTC
tggacgggtcgaatc

SEQ ID NO: 83857 - DNA, 15 bp, Artificial Sequence
  dgRNA
  __NTC
gtgtaccggcggtca

SEQ ID NO: 83858 - DNA, 15 bp, Artificial Sequence
  dgRNA
  __NTC
cgcctaccttcgcgt

SEQ ID NO: 83859 - DNA, 15 bp, Artificial Sequence
  dgRNA
  __NTC
aaccttcgcgcaata

SEQ ID NO: 83860 - DNA, 15 bp, Artificial Sequence
  dgRNA
  __NTC
ctgtccgtactcgcg

SEQ ID NO: 83861 - DNA, 15 bp, Artificial Sequence
  dgRNA
  __NTC
cgacggaccatagta

SEQ ID NO: 83862 - DNA, 15 bp, Artificial Sequence
  dgRNA
  __NTC
acggcacggtcgtgt

SEQ ID NO: 83863 - DNA, 15 bp, Artificial Sequence
  dgRNA
  __NTC
agcggtccgccaatt

SEQ ID NO: 83864 - DNA, 15 bp, Artificial Sequence
  dgRNA
  __NTC
ctagcgggcccgtaa

SEQ ID NO: 83865 - DNA, 15 bp, Artificial Sequence
  dgRNA
  __NTC
tttacggcgcacgtg

SEQ ID NO: 83866 - DNA, 15 bp, Artificial Sequence
  dgRNA
  __NTC
cgcgacgtcccggct

SEQ ID NO: 83867 - DNA, 15 bp, Artificial Sequence
  dgRNA
  __NTC
gcactatccgggtcg

SEQ ID NO: 83868 - DNA, 15 bp, Artificial Sequence
  dgRNA
  __NTC
cgaattcgttagggc

SEQ ID NO: 83869 - DNA, 15 bp, Artificial Sequence
  dgRNA
  __NTC
tggcgcgttcggccc

SEQ ID NO: 83870 - DNA, 15 bp, Artificial Sequence
  dgRNA
  __NTC
acgtgttactagcgc

SEQ ID NO: 83871 - DNA, 15 bp, Artificial Sequence
  dgRNA
  __NTC
actccatacggcgac

SEQ ID NO: 83872 - DNA, 15 bp, Artificial Sequence
  dgRNA
  __NTC
cgtgtcgttgtcacg

SEQ ID NO: 83873 - DNA, 15 bp, Artificial Sequence
  dgRNA
  __NTC
gattggcgtagcgta

SEQ ID NO: 83874 - DNA, 15 bp, Artificial Sequence
  dgRNA
  __NTC
tcgccagattaccgg

SEQ ID NO: 83875 - DNA, 15 bp, Artificial Sequence
  dgRNA
  __NTC
cgagccgttcgttgc

SEQ ID NO: 83876 - DNA, 15 bp, Artificial Sequence
  dgRNA
  __NTC
cggaggagcgtcgtt

SEQ ID NO: 83877 - DNA, 15 bp, Artificial Sequence
  dgRNA
  __NTC
tggattgcgctacga

SEQ ID NO: 83878 - DNA, 15 bp, Artificial Sequence
  dgRNA
  __NTC
ctgtacgataggcgg

SEQ ID NO: 83879 - DNA, 15 bp, Artificial Sequence
  dgRNA
  __NTC
gctgatccgctaccg

SEQ ID NO: 83880 - DNA, 15 bp, Artificial Sequence
  dgRNA
  __NTC
gcgtaacggggttga

SEQ ID NO: 83881 - DNA, 15 bp, Artificial Sequence
  dgRNA
  __NTC
cacgcatcacgacgt

SEQ ID NO: 83882 - DNA, 15 bp, Artificial Sequence
  dgRNA
  __NTC
acggatacgtagtgc

SEQ ID NO: 83883 - DNA, 15 bp, Artificial Sequence
  dgRNA
  __NTC
tacgagttgcggcaa

SEQ ID NO: 83884 - DNA, 15 bp, Artificial Sequence
  dgRNA
  __NTC
cgtcgatataacctc

SEQ ID NO: 83885 - DNA, 15 bp, Artificial Sequence
  dgRNA
  __NTC
gacgccgaaccgcct

SEQ ID NO: 83886 - DNA, 15 bp, Artificial Sequence
  dgRNA
  __NTC
aatacgacggtaggc

SEQ ID NO: 83887 - DNA, 15 bp, Artificial Sequence
  dgRNA
  __NTC
aacggcgacacgaac

SEQ ID NO: 83888 - DNA, 15 bp, Artificial Sequence
  dgRNA
  __NTC
gcggggacgacccgt

SEQ ID NO: 83889 - DNA, 15 bp, Artificial Sequence
  dgRNA
  __NTC
tcgccacgccgacat

SEQ ID NO: 83890 - DNA, 15 bp, Artificial Sequence
  dgRNA
  __NTC
gatagagtaccgacg

SEQ ID NO: 83891 - DNA, 15 bp, Artificial Sequence
  dgRNA
  __NTC
ggcggctattgtcgc

SEQ ID NO: 83892 - DNA, 15 bp, Artificial Sequence
  dgRNA
  __NTC
cgtgaccgcgagcga

SEQ ID NO: 83893 - DNA, 15 bp, Artificial Sequence
  dgRNA
  __NTC
ctagcggcggcgctt

SEQ ID NO: 83894 - DNA, 15 bp, Artificial Sequence
  dgRNA
  __NTC
ggattgaccgacgtc

SEQ ID NO: 83895 - DNA, 15 bp, Artificial Sequence
  dgRNA
  __NTC
cgtcggtgggcgact

SEQ ID NO: 83896 - DNA, 15 bp, Artificial Sequence
  dgRNA
  __NTC
gcgggaatagtccgg

SEQ ID NO: 83897 - DNA, 15 bp, Artificial Sequence
  dgRNA
  __NTC
ggcgttcgaggtcgt

SEQ ID NO: 83898 - DNA, 15 bp, Artificial Sequence
  dgRNA
  __NTC
gtacgcggcgcaggg

SEQ ID NO: 83899 - DNA, 15 bp, Artificial Sequence
  dgRNA
  __NTC
cgttgtacgacggtg

SEQ ID NO: 83900 - DNA, 15 bp, Artificial Sequence
  dgRNA
  __NTC
gcctattgacggccg

SEQ ID NO: 83901 - DNA, 15 bp, Artificial Sequence
  dgRNA
  __NTC
tcgaagattaggccg

SEQ ID NO: 83902 - DNA, 15 bp, Artificial Sequence
  dgRNA
  __NTC
cccgtaccgcggatc

SEQ ID NO: 83903 - DNA, 15 bp, Artificial Sequence
  dgRNA
  __NTC
ctactagcgcgctgc

SEQ ID NO: 83904 - DNA, 15 bp, Artificial Sequence
  dgRNA
  __NTC
ggtttcggcgtagtg

SEQ ID NO: 83905 - DNA, 15 bp, Artificial Sequence
  dgRNA
  __NTC
actgggcgcgcgtca

SEQ ID NO: 83906 - DNA, 15 bp, Artificial Sequence
  dgRNA
  __NTC
cgtggtccaccgacg

SEQ ID NO: 83907 - DNA, 15 bp, Artificial Sequence
  dgRNA
  __NTC
atccggccgcataat

SEQ ID NO: 83908 - DNA, 15 bp, Artificial Sequence
  dgRNA
  __NTC
gggttcgtaccgtcc

SEQ ID NO: 83909 - DNA, 15 bp, Artificial Sequence
  dgRNA
  __NTC
tggaacgcgtgacgt

SEQ ID NO: 83910 - DNA, 15 bp, Artificial Sequence
  dgRNA
  __NTC
cgagccggcatatac

SEQ ID NO: 83911 - DNA, 15 bp, Artificial Sequence
  dgRNA
  __NTC
ctcgccggttcaata

SEQ ID NO: 83912 - DNA, 15 bp, Artificial Sequence
  dgRNA
  __NTC
gtaaccaacgaccgg

SEQ ID NO: 83913 - DNA, 15 bp, Artificial Sequence
  dgRNA
  __NTC
tgacggccgaactaa

SEQ ID NO: 83914 - DNA, 15 bp, Artificial Sequence
  dgRNA
  __NTC
cccgtcgcggtctcg

SEQ ID NO: 83915 - DNA, 15 bp, Artificial Sequence
  dgRNA
  __NTC
cattgagcgcccgcg

SEQ ID NO: 83916 - DNA, 15 bp, Artificial Sequence
  dgRNA
  __NTC
caacgcccgacggtg

SEQ ID NO: 83917 - DNA, 15 bp, Artificial Sequence
  dgRNA
  __NTC
ccgagcgtttggcga

SEQ ID NO: 83918 - DNA, 15 bp, Artificial Sequence
  dgRNA
  __NTC
gtgttacgcggctaa

SEQ ID NO: 83919 - DNA, 15 bp, Artificial Sequence
  dgRNA
  __NTC
acgtaaacgggctac

SEQ ID NO: 83920 - DNA, 15 bp, Artificial Sequence
  dgRNA
  __NTC
gctatcgaccggttc

SEQ ID NO: 83921 - DNA, 15 bp, Artificial Sequence
  dgRNA
  __NTC
gcgctagcgtccaat

SEQ ID NO: 83922 - DNA, 15 bp, Artificial Sequence
  dgRNA
  __NTC
agacggcgtccgaac

SEQ ID NO: 83923 - DNA, 15 bp, Artificial Sequence
  dgRNA
  __NTC
gtacgcattgcgcaa

SEQ ID NO: 83924 - DNA, 15 bp, Artificial Sequence
  dgRNA
  __NTC
cctagcgtcataacg

SEQ ID NO: 83925 - DNA, 15 bp, Artificial Sequence
  dgRNA
  __NTC
cgacgttagtgtact

SEQ ID NO: 83926 - DNA, 15 bp, Artificial Sequence
  dgRNA
  __NTC
acatatcgcggacca

SEQ ID NO: 83927 - DNA, 15 bp, Artificial Sequence
  dgRNA
  __NTC
accgggccaatcgta

SEQ ID NO: 83928 - DNA, 15 bp, Artificial Sequence
  dgRNA
  __NTC
tgcgcgccgtttatg

SEQ ID NO: 83929 - DNA, 15 bp, Artificial Sequence
  dgRNA
  __NTC
gatcagtacgcgaca

SEQ ID NO: 83930 - DNA, 15 bp, Artificial Sequence
  dgRNA
  __NTC
tattcgccgcctata

SEQ ID NO: 83931 - DNA, 15 bp, Artificial Sequence
  dgRNA
  __NTC
actacgacggatctg

SEQ ID NO: 83932 - DNA, 15 bp, Artificial Sequence
  dgRNA
  __NTC
cggagtcgaacggag

SEQ ID NO: 83933 - DNA, 15 bp, Artificial Sequence
  dgRNA
  __NTC
caccgccggggtcgt

SEQ ID NO: 83934 - DNA, 15 bp, Artificial Sequence
  dgRNA
  __NTC
taccgctctatgcga

SEQ ID NO: 83935 - DNA, 15 bp, Artificial Sequence
  dgRNA
  __NTC
agcgcaccgcgtagg

SEQ ID NO: 83936 - DNA, 15 bp, Artificial Sequence
  dgRNA
  __NTC
acttgcgaccggtgc

SEQ ID NO: 83937 - DNA, 15 bp, Artificial Sequence
  dgRNA
  __NTC
tgcgccgtattatcc

SEQ ID NO: 83938 - DNA, 15 bp, Artificial Sequence
  dgRNA
  __NTC
gcgttcggccggctt

SEQ ID NO: 83939 - DNA, 15 bp, Artificial Sequence
  dgRNA
  __NTC
acgacgatttagtcc

SEQ ID NO: 83940 - DNA, 15 bp, Artificial Sequence
  dgRNA
  __NTC
ccgtccacgcgacca

SEQ ID NO: 83941 - DNA, 15 bp, Artificial Sequence
  dgRNA
  __NTC
cggatcggtaggtca

SEQ ID NO: 83942 - DNA, 15 bp, Artificial Sequence
  dgRNA
  __NTC
gatcgccggcatgat

SEQ ID NO: 83943 - DNA, 15 bp, Artificial Sequence
  dgRNA
  __NTC
ggcggtcagtcgcgc

SEQ ID NO: 83944 - DNA, 15 bp, Artificial Sequence
  dgRNA
  __NTC
agtaccgaacgctag

SEQ ID NO: 83945 - DNA, 15 bp, Artificial Sequence
  dgRNA
  __NTC
gatagcgactctacg

SEQ ID NO: 83946 - DNA, 15 bp, Artificial Sequence
  dgRNA
  __NTC
ccgggactaggttcg

SEQ ID NO: 83947 - DNA, 15 bp, Artificial Sequence
  dgRNA
  __NTC
cgggctattaacgtg

SEQ ID NO: 83948 - DNA, 15 bp, Artificial Sequence
  dgRNA
  __NTC
gcgtggtcgcacggc

SEQ ID NO: 83949 - DNA, 15 bp, Artificial Sequence
  dgRNA
  __NTC
accgatcgatgctag

SEQ ID NO: 83950 - DNA, 15 bp, Artificial Sequence
  dgRNA
  __NTC
cgatcccgtaatggg

SEQ ID NO: 83951 - DNA, 15 bp, Artificial Sequence
  dgRNA
  __NTC
ctgaacgcacgccga

SEQ ID NO: 83952 - DNA, 15 bp, Artificial Sequence
  dgRNA
  __NTC
cgcggcaacccctat

SEQ ID NO: 83953 - DNA, 15 bp, Artificial Sequence
  dgRNA
  __NTC
gccgagtatgcgtat

SEQ ID NO: 83954 - DNA, 15 bp, Artificial Sequence
  dgRNA
  __NTC
cgcacggaccgtgca

SEQ ID NO: 83955 - DNA, 15 bp, Artificial Sequence
  dgRNA
  __NTC
ccagaaaccgcgcgt

SEQ ID NO: 83956 - DNA, 15 bp, Artificial Sequence
  dgRNA
  __NTC
agcgtcgcggccttt

SEQ ID NO: 83957 - DNA, 15 bp, Artificial Sequence
  dgRNA
  __NTC
gttaaaccgcgattc

SEQ ID NO: 83958 - DNA, 15 bp, Artificial Sequence
  dgRNA
  __NTC
taggcccgacggtgt

SEQ ID NO: 83959 - DNA, 15 bp, Artificial Sequence
  dgRNA
  __NTC
gcggacagcgcgcat

SEQ ID NO: 83960 - DNA, 15 bp, Artificial Sequence
  dgRNA
  __NTC
gagacgtaattccgc

SEQ ID NO: 83961 - DNA, 15 bp, Artificial Sequence
  dgRNA
  __NTC
ccagcgcgagtgacg

SEQ ID NO: 83962 - DNA, 15 bp, Artificial Sequence
  dgRNA
  __NTC
attatcctgcgcgcg

SEQ ID NO: 83963 - DNA, 15 bp, Artificial Sequence
  dgRNA
  __NTC
gcccgtaagatccgg

SEQ ID NO: 83964 - DNA, 15 bp, Artificial Sequence
  dgRNA
  __NTC
tcgtatcgcaatcag

SEQ ID NO: 83965 - DNA, 15 bp, Artificial Sequence
  dgRNA
  __NTC
tgccgtatgttaccg

SEQ ID NO: 83966 - DNA, 15 bp, Artificial Sequence
  dgRNA
  __NTC
atctgcgtctcgcgt

SEQ ID NO: 83967 - DNA, 15 bp, Artificial Sequence
  dgRNA
  __NTC
gacgaactcgtcaac

SEQ ID NO: 83968 - DNA, 15 bp, Artificial Sequence
  dgRNA
  __NTC
cacggaggccgtcga

SEQ ID NO: 83969 - DNA, 15 bp, Artificial Sequence
  dgRNA
  __NTC
cgacgagctcaatta

SEQ ID NO: 83970 - DNA, 15 bp, Artificial Sequence
  dgRNA
  __NTC
atcgttgtaggtacg

SEQ ID NO: 83971 - DNA, 15 bp, Artificial Sequence
  dgRNA
  __NTC
acgtgagtcgactag

SEQ ID NO: 83972 - DNA, 15 bp, Artificial Sequence
  dgRNA
  __NTC
caaggtcgtccgccg

SEQ ID NO: 83973 - DNA, 15 bp, Artificial Sequence
  dgRNA
  __NTC
ccgtgtcggtttcgt

SEQ ID NO: 83974 - DNA, 15 bp, Artificial Sequence
  dgRNA
  __NTC
atgagccgactacgg

SEQ ID NO: 83975 - DNA, 15 bp, Artificial Sequence
  dgRNA
  __NTC
taacgaatccggcca

SEQ ID NO: 83976 - DNA, 15 bp, Artificial Sequence
  dgRNA
  __NTC
taccgagtttcgtac

SEQ ID NO: 83977 - DNA, 15 bp, Artificial Sequence
  dgRNA
  __NTC
gccggatcagccgta

SEQ ID NO: 83978 - DNA, 15 bp, Artificial Sequence
  dgRNA
  __NTC
cacgcgactaacacg

SEQ ID NO: 83979 - DNA, 15 bp, Artificial Sequence
  dgRNA
  __NTC
gacaattcgcggggc

SEQ ID NO: 83980 - DNA, 15 bp, Artificial Sequence
  dgRNA
  __NTC
tatcacgccgcaact

SEQ ID NO: 83981 - DNA, 15 bp, Artificial Sequence
  dgRNA
  __NTC
tcgtaatcacccgcc

SEQ ID NO: 83982 - DNA, 15 bp, Artificial Sequence
  dgRNA
  __NTC
gattcgtctagggcg

SEQ ID NO: 83983 - DNA, 15 bp, Artificial Sequence
  dgRNA
  __NTC
taatcgtctaatcgc

SEQ ID NO: 83984 - DNA, 15 bp, Artificial Sequence
  dgRNA
  __NTC
ccggtccgggctatc

SEQ ID NO: 83985 - DNA, 15 bp, Artificial Sequence
  dgRNA
  __NTC
gcagccgcggacgtt

SEQ ID NO: 83986 - DNA, 15 bp, Artificial Sequence
  dgRNA
  __NTC
cacacgaaccgaacg

SEQ ID NO: 83987 - DNA, 15 bp, Artificial Sequence
  dgRNA
  __NTC
cgctatcactacacg

SEQ ID NO: 83988 - DNA, 15 bp, Artificial Sequence
  dgRNA
  __NTC
ttaataccgggcgct

SEQ ID NO: 83989 - DNA, 15 bp, Artificial Sequence
  dgRNA
  __NTC
acgcgtacacgttat

SEQ ID NO: 83990 - DNA, 15 bp, Artificial Sequence
  dgRNA
  __NTC
ccggtcaatccgtcc

SEQ ID NO: 83991 - DNA, 15 bp, Artificial Sequence
  dgRNA
  __NTC
cgtccgcaaattaac

SEQ ID NO: 83992 - DNA, 15 bp, Artificial Sequence
  dgRNA
  __NTC
ggcgccccatgcgac

SEQ ID NO: 83993 - DNA, 15 bp, Artificial Sequence
  dgRNA
  __NTC
tttggtctacccgcg

SEQ ID NO: 83994 - DNA, 15 bp, Artificial Sequence
  dgRNA
  __NTC
gatcggccgaagagt

SEQ ID NO: 83995 - DNA, 15 bp, Artificial Sequence
  dgRNA
  __NTC
accggcttgtcgacc

SEQ ID NO: 83996 - DNA, 15 bp, Artificial Sequence
  dgRNA
  __NTC
aacgcacacgcggtc

SEQ ID NO: 83997 - DNA, 15 bp, Artificial Sequence
  dgRNA
  __NTC
cgctaatttggttcg

SEQ ID NO: 83998 - DNA, 15 bp, Artificial Sequence
  dgRNA
  __NTC
gtcgtagatcgctat

SEQ ID NO: 83999 - DNA, 15 bp, Artificial Sequence
  dgRNA
  __NTC
tactaccgcccgaat

SEQ ID NO: 84000 - DNA, 15 bp, Artificial Sequence
  dgRNA
  __NTC
ggtcgtgcgtaggtc

SEQ ID NO: 84001 - DNA, 15 bp, Artificial Sequence
  dgRNA
  __NTC
ggtcgttggaccgca

SEQ ID NO: 84002 - DNA, 15 bp, Artificial Sequence
  dgRNA
  __NTC
ggttgagcgattacg

SEQ ID NO: 84003 - DNA, 15 bp, Artificial Sequence
  dgRNA
  __NTC
attacgaactaccgg

SEQ ID NO: 84004 - DNA, 15 bp, Artificial Sequence
  dgRNA
  __NTC
gcggattgagtcggt

SEQ ID NO: 84005 - DNA, 15 bp, Artificial Sequence
  dgRNA
  __NTC
tctgcgagcgtcgtg

SEQ ID NO: 84006 - DNA, 15 bp, Artificial Sequence
  dgRNA
  __NTC
ccccattacgagccg

SEQ ID NO: 84007 - DNA, 15 bp, Artificial Sequence
  dgRNA
  __NTC
tcgcgagagtatatc

SEQ ID NO: 84008 - DNA, 15 bp, Artificial Sequence
  dgRNA
  __NTC
gcgacccgcttatgt

SEQ ID NO: 84009 - DNA, 15 bp, Artificial Sequence
  dgRNA
  __NTC
gatgtccgatcgcaa

SEQ ID NO: 84010 - DNA, 15 bp, Artificial Sequence
  dgRNA
  __NTC
atcgcagcccgcgtg

SEQ ID NO: 84011 - DNA, 15 bp, Artificial Sequence
  dgRNA
  __NTC
gcgatcactcgtagc

SEQ ID NO: 84012 - DNA, 15 bp, Artificial Sequence
  dgRNA
  __NTC
taccgcttaggacgg

SEQ ID NO: 84013 - DNA, 15 bp, Artificial Sequence
  dgRNA
  __NTC
agttaatgcggcgcc

SEQ ID NO: 84014 - DNA, 15 bp, Artificial Sequence
  dgRNA
  __NTC
gagcggtctatttcg

SEQ ID NO: 84015 - DNA, 15 bp, Artificial Sequence
  dgRNA
  __NTC
gaggcgttacgctgc

SEQ ID NO: 84016 - DNA, 15 bp, Artificial Sequence
  dgRNA
  __NTC
ttgcccggaccggtg

SEQ ID NO: 84017 - DNA, 15 bp, Artificial Sequence
  dgRNA
  __NTC
acgagccggatgtac

SEQ ID NO: 84018 - DNA, 15 bp, Artificial Sequence
  dgRNA
  __NTC
cctactcgcccgtac

SEQ ID NO: 84019 - DNA, 15 bp, Artificial Sequence
  dgRNA
  __NTC
gacgtaaccaattcg

SEQ ID NO: 84020 - DNA, 15 bp, Artificial Sequence
  dgRNA
  __NTC
cggctaaacgcagta

SEQ ID NO: 84021 - DNA, 15 bp, Artificial Sequence
  dgRNA
  __NTC
gccggccgtattcac

SEQ ID NO: 84022 - DNA, 15 bp, Artificial Sequence
  dgRNA
  __NTC
gtacgttgggccgtc

SEQ ID NO: 84023 - DNA, 15 bp, Artificial Sequence
  dgRNA
  __NTC
gtatacgttgcggga

SEQ ID NO: 84024 - DNA, 15 bp, Artificial Sequence
  dgRNA
  __NTC
cggcccgcaatgcgc

SEQ ID NO: 84025 - DNA, 15 bp, Artificial Sequence
  dgRNA
  __NTC
agtggtcgcgtacca

SEQ ID NO: 84026 - DNA, 15 bp, Artificial Sequence
  dgRNA
  __NTC
ggtacgaattatcgt

SEQ ID NO: 84027 - DNA, 15 bp, Artificial Sequence
  dgRNA
  __NTC
agtgtaccgctcggc

SEQ ID NO: 84028 - DNA, 15 bp, Artificial Sequence
  dgRNA
  __NTC
tctcgggtcgctccg

SEQ ID NO: 84029 - DNA, 15 bp, Artificial Sequence
  dgRNA
  __NTC
ccgggtcaacgccta

SEQ ID NO: 84030 - DNA, 15 bp, Artificial Sequence
  dgRNA
  __NTC
caatactcgagtcgt

SEQ ID NO: 84031 - DNA, 15 bp, Artificial Sequence
  dgRNA
  __NTC
agcctatcgcgtaga

SEQ ID NO: 84032 - DNA, 15 bp, Artificial Sequence
  dgRNA
  __NTC
gccgccgttatggat

SEQ ID NO: 84033 - DNA, 15 bp, Artificial Sequence
  dgRNA
  __NTC
taacggcacacgccg

SEQ ID NO: 84034 - DNA, 15 bp, Artificial Sequence
  dgRNA
  __NTC
caaccttaattcgcg

SEQ ID NO: 84035 - DNA, 15 bp, Artificial Sequence
  dgRNA
  __NTC
cggcctcgctcgcat

SEQ ID NO: 84036 - DNA, 15 bp, Artificial Sequence
  dgRNA
  __NTC
ggcgcgtagttgctt

SEQ ID NO: 84037 - DNA, 15 bp, Artificial Sequence
  dgRNA
  __NTC
atcttcgcggccggc

SEQ ID NO: 84038 - DNA, 15 bp, Artificial Sequence
  dgRNA
  __NTC
cgttaaacctactcg

SEQ ID NO: 84039 - DNA, 15 bp, Artificial Sequence
  dgRNA
  __NTC
cgcgggatttaggtc

SEQ ID NO: 84040 - DNA, 15 bp, Artificial Sequence
  dgRNA
  __NTC
aatatcgactgccgc

SEQ ID NO: 84041 - DNA, 15 bp, Artificial Sequence
  dgRNA
  __NTC
taccggtcgatccta

SEQ ID NO: 84042 - DNA, 15 bp, Artificial Sequence
  dgRNA
  __NTC
tttgcggagctacgc

SEQ ID NO: 84043 - DNA, 15 bp, Artificial Sequence
  dgRNA
  __NTC
ggcgatatgacggca

SEQ ID NO: 84044 - DNA, 15 bp, Artificial Sequence
  dgRNA
  __NTC
cggctgtatacccgg

SEQ ID NO: 84045 - DNA, 15 bp, Artificial Sequence
  dgRNA
  __NTC
cctgctcgcggcgtt

SEQ ID NO: 84046 - DNA, 15 bp, Artificial Sequence
  dgRNA
  __NTC
cgattacggccaagt

SEQ ID NO: 84047 - DNA, 15 bp, Artificial Sequence
  dgRNA
  __NTC
gcgacaccggtccac

SEQ ID NO: 84048 - DNA, 15 bp, Artificial Sequence
  dgRNA
  __NTC
cgcgactaggtcagg

SEQ ID NO: 84049 - DNA, 15 bp, Artificial Sequence
  dgRNA
  __NTC
gaacgcaacttatcg

SEQ ID NO: 84050 - DNA, 15 bp, Artificial Sequence
  dgRNA
  __NTC
actaagcgttgccgg

SEQ ID NO: 84051 - DNA, 15 bp, Artificial Sequence
  dgRNA
  __NTC
ccgtggcgcttcgaa

SEQ ID NO: 84052 - DNA, 15 bp, Artificial Sequence
  dgRNA
  __NTC
accgtgcgaatagga

SEQ ID NO: 84053 - DNA, 15 bp, Artificial Sequence
  dgRNA
  __NTC
gtaacgagcgttgac

SEQ ID NO: 84054 - DNA, 15 bp, Artificial Sequence
  dgRNA
  __NTC
tccgaaggcgagtat

SEQ ID NO: 84055 - DNA, 15 bp, Artificial Sequence
  dgRNA
  __NTC
cggtctagtgaccgt

SEQ ID NO: 84056 - DNA, 15 bp, Artificial Sequence
  dgRNA
  __NTC
ccctcgttagaccgt

SEQ ID NO: 84057 - DNA, 15 bp, Artificial Sequence
  dgRNA
  __NTC
cgcggtgtagtagct

SEQ ID NO: 84058 - DNA, 15 bp, Artificial Sequence
  dgRNA
  __NTC
accggtcgatctgta

SEQ ID NO: 84059 - DNA, 15 bp, Artificial Sequence
  dgRNA
  __NTC
tcgaaccgtaaggcc

SEQ ID NO: 84060 - DNA, 15 bp, Artificial Sequence
  dgRNA
  __NTC
cgcattaagggtcgt

SEQ ID NO: 84061 - DNA, 15 bp, Artificial Sequence
  dgRNA
  __NTC
cgtaacggggtgagc

SEQ ID NO: 84062 - DNA, 15 bp, Artificial Sequence
  dgRNA
  __NTC
gtacgctcaccgcat

SEQ ID NO: 84063 - DNA, 15 bp, Artificial Sequence
  dgRNA
  __NTC
agatatgttcgaccg

SEQ ID NO: 84064 - DNA, 15 bp, Artificial Sequence
  dgRNA
  __NTC
ggacgattccgtact

SEQ ID NO: 84065 - DNA, 15 bp, Artificial Sequence
  dgRNA
  __NTC
gccgtcctgcgcggt

SEQ ID NO: 84066 - DNA, 15 bp, Artificial Sequence
  dgRNA
  __NTC
tacggattttgccgc

SEQ ID NO: 84067 - DNA, 15 bp, Artificial Sequence
  dgRNA
  __NTC
cgtaccattgtgccg

SEQ ID NO: 84068 - DNA, 15 bp, Artificial Sequence
  dgRNA
  __NTC
cggctataaccgcat

SEQ ID NO: 84069 - DNA, 15 bp, Artificial Sequence
  dgRNA
  __NTC
tgagacgcacgcccg

SEQ ID NO: 84070 - DNA, 15 bp, Artificial Sequence
  dgRNA
  __NTC
ttcgtcaatgcgggc

SEQ ID NO: 84071 - DNA, 15 bp, Artificial Sequence
  dgRNA
  __NTC
acgtccaagcgacta

SEQ ID NO: 84072 - DNA, 15 bp, Artificial Sequence
  dgRNA
  __NTC
acccacgatggcgcg

SEQ ID NO: 84073 - DNA, 15 bp, Artificial Sequence
  dgRNA
  __NTC
ccgacttgcgttacc

SEQ ID NO: 84074 - DNA, 15 bp, Artificial Sequence
  dgRNA
  __NTC
gagcgttttttacgc

SEQ ID NO: 84075 - DNA, 15 bp, Artificial Sequence
  dgRNA
  __NTC
ccgttggagtaacgg

SEQ ID NO: 84076 - DNA, 15 bp, Artificial Sequence
  dgRNA
  __NTC
gcgtccacgcagtcg

SEQ ID NO: 84077 - DNA, 15 bp, Artificial Sequence
  dgRNA
  __NTC
ctttagcggcgctta

SEQ ID NO: 84078 - DNA, 15 bp, Artificial Sequence
  dgRNA
  __NTC
tggttatcgcggtag

SEQ ID NO: 84079 - DNA, 15 bp, Artificial Sequence
  dgRNA
  __NTC
gtaagtcatcgcggc

SEQ ID NO: 84080 - DNA, 15 bp, Artificial Sequence
  dgRNA
  __NTC
cgcgttggagcccta

SEQ ID NO: 84081 - DNA, 15 bp, Artificial Sequence
  dgRNA
  __NTC
atatacccgtgatcg

SEQ ID NO: 84082 - DNA, 15 bp, Artificial Sequence
  dgRNA
  __NTC
cgtacagcggtatcc

SEQ ID NO: 84083 - DNA, 15 bp, Artificial Sequence
  dgRNA
  __NTC
atcgcgttaggctca

SEQ ID NO: 84084 - DNA, 15 bp, Artificial Sequence
  dgRNA
  __NTC
gacgttgagcgccta

SEQ ID NO: 84085 - DNA, 15 bp, Artificial Sequence
  dgRNA
  __NTC
gccgctagcaacgct

SEQ ID NO: 84086 - DNA, 15 bp, Artificial Sequence
  dgRNA
  __NTC
gcggttctaggtcgg

SEQ ID NO: 84087 - DNA, 15 bp, Artificial Sequence
  dgRNA
  __NTC
ggttaaacgcgaggt

SEQ ID NO: 84088 - DNA, 15 bp, Artificial Sequence
  dgRNA
  __NTC
ggtatcgtcggaggg

SEQ ID NO: 84089 - DNA, 15 bp, Artificial Sequence
  dgRNA
  __NTC
cgcgagcaaacgtgc

SEQ ID NO: 84090 - DNA, 15 bp, Artificial Sequence
  dgRNA
  __NTC
tttcgtagcgaatcc

SEQ ID NO: 84091 - DNA, 15 bp, Artificial Sequence
  dgRNA
  __NTC
attggtcggcggtgc

SEQ ID NO: 84092 - DNA, 15 bp, Artificial Sequence
  dgRNA
  __NTC
aaatcgtattgcgac

SEQ ID NO: 84093 - DNA, 15 bp, Artificial Sequence
  dgRNA
  __NTC
ggtccgcgctgacta

SEQ ID NO: 84094 - DNA, 15 bp, Artificial Sequence
  dgRNA
  __NTC
tactgcaaatccgcg

SEQ ID NO: 84095 - DNA, 15 bp, Artificial Sequence
  dgRNA
  __NTC
tggtagcgcgcggcc

SEQ ID NO: 84096 - DNA, 15 bp, Artificial Sequence
  dgRNA
  __NTC
tagagctatgacgcg

SEQ ID NO: 84097 - DNA, 15 bp, Artificial Sequence
  dgRNA
  __NTC
cggacgatctatggg

SEQ ID NO: 84098 - DNA, 15 bp, Artificial Sequence
  dgRNA
  __NTC
cggttactcgctagc

SEQ ID NO: 84099 - DNA, 15 bp, Artificial Sequence
  dgRNA
  __NTC
ggatacgcacccggt

SEQ ID NO: 84100 - DNA, 15 bp, Artificial Sequence
  dgRNA
  __NTC
gcgtaactcgtgtta

SEQ ID NO: 84101 - DNA, 15 bp, Artificial Sequence
  dgRNA
  __NTC
ctccattcgcgcccg

SEQ ID NO: 84102 - DNA, 15 bp, Artificial Sequence
  dgRNA
  __NTC
ttcgactcaagtcgc

SEQ ID NO: 84103 - DNA, 15 bp, Artificial Sequence
  dgRNA
  __NTC
acggcccagcgtcgt

SEQ ID NO: 84104 - DNA, 15 bp, Artificial Sequence
  dgRNA
  __NTC
gcgtgcgactagcct

SEQ ID NO: 84105 - DNA, 15 bp, Artificial Sequence
  dgRNA
  __NTC
ggcacgagtatacga

SEQ ID NO: 84106 - DNA, 15 bp, Artificial Sequence
  dgRNA
  __NTC
cgacgctaaccttgc

SEQ ID NO: 84107 - DNA, 15 bp, Artificial Sequence
  dgRNA
  __NTC
aggtctcgaaccgac

SEQ ID NO: 84108 - DNA, 15 bp, Artificial Sequence
  dgRNA
  __NTC
cgtcgcggcggtcgc

SEQ ID NO: 84109 - DNA, 15 bp, Artificial Sequence
  dgRNA
  __NTC
gtgcttcgaccgtat

SEQ ID NO: 84110 - DNA, 15 bp, Artificial Sequence
  dgRNA
  __NTC
cgttgggatatacga

SEQ ID NO: 84111 - DNA, 15 bp, Artificial Sequence
  dgRNA
  __NTC
caacggttgacgtcc

SEQ ID NO: 84112 - DNA, 15 bp, Artificial Sequence
  dgRNA
  __NTC
gaacccgctcggaat

SEQ ID NO: 84113 - DNA, 15 bp, Artificial Sequence
  dgRNA
  __NTC
accacgcgttaagtc

SEQ ID NO: 84114 - DNA, 15 bp, Artificial Sequence
  dgRNA
  __NTC
gcggccctccgtcta

SEQ ID NO: 84115 - DNA, 15 bp, Artificial Sequence
  dgRNA
  __NTC
cggtttgacggcctg

SEQ ID NO: 84116 - DNA, 15 bp, Artificial Sequence
  dgRNA
  __NTC
gacgattcgttggca

SEQ ID NO: 84117 - DNA, 15 bp, Artificial Sequence
  dgRNA
  __NTC
attcgctaagaggcg

SEQ ID NO: 84118 - DNA, 15 bp, Artificial Sequence
  dgRNA
  __NTC
agtcctaccgcgtag

SEQ ID NO: 84119 - DNA, 15 bp, Artificial Sequence
  dgRNA
  __NTC
gcactcgagaccgcc

SEQ ID NO: 84120 - DNA, 15 bp, Artificial Sequence
  dgRNA
  __NTC
cccgcgtccgagtgt

SEQ ID NO: 84121 - DNA, 15 bp, Artificial Sequence
  dgRNA
  __NTC
gtccgcgacagtatt

SEQ ID NO: 84122 - DNA, 15 bp, Artificial Sequence
  dgRNA
  __NTC
agcgttacgcaacat

SEQ ID NO: 84123 - DNA, 15 bp, Artificial Sequence
  dgRNA
  __NTC
taaagcgcgtactac

SEQ ID NO: 84124 - DNA, 15 bp, Artificial Sequence
  dgRNA
  __NTC
cgataagcactcgat

SEQ ID NO: 84125 - DNA, 15 bp, Artificial Sequence
  dgRNA
  __NTC
gtcatacgagacgtt

SEQ ID NO: 84126 - DNA, 15 bp, Artificial Sequence
  dgRNA
  __NTC
cgacgcgggcagaat

SEQ ID NO: 84127 - DNA, 15 bp, Artificial Sequence
  dgRNA
  __NTC
gtcgtcggaatacaa

SEQ ID NO: 84128 - DNA, 15 bp, Artificial Sequence
  dgRNA
  __NTC
gtctataaccgcggg

SEQ ID NO: 84129 - DNA, 15 bp, Artificial Sequence
  dgRNA
  __NTC
ttaccggcgttccta

SEQ ID NO: 84130 - DNA, 15 bp, Artificial Sequence
  dgRNA
  __NTC
agctactcgaaccgt

SEQ ID NO: 84131 - DNA, 15 bp, Artificial Sequence
  dgRNA
  __NTC
cgtcgcatgttagga

SEQ ID NO: 84132 - DNA, 15 bp, Artificial Sequence
  dgRNA
  __NTC
gctttacgtcgatta

SEQ ID NO: 84133 - DNA, 15 bp, Artificial Sequence
  dgRNA
  __NTC
cgatcatatatcgtc

SEQ ID NO: 84134 - DNA, 15 bp, Artificial Sequence
  dgRNA
  __NTC
agaacgacgaccgga

SEQ ID NO: 84135 - DNA, 15 bp, Artificial Sequence
  dgRNA
  __NTC
gcgtacactccgagc

SEQ ID NO: 84136 - DNA, 15 bp, Artificial Sequence
  dgRNA
  __NTC
tagacccgcatcgcc

SEQ ID NO: 84137 - DNA, 15 bp, Artificial Sequence
  dgRNA
  __NTC
cgcatctagcgatct

SEQ ID NO: 84138 - DNA, 15 bp, Artificial Sequence
  dgRNA
  __NTC
ggctatctcgcgcaa

SEQ ID NO: 84139 - DNA, 15 bp, Artificial Sequence
  dgRNA
  __NTC
tgcggagtgtacgtc

SEQ ID NO: 84140 - DNA, 15 bp, Artificial Sequence
  dgRNA
  __NTC
cgccgggtcagctta

SEQ ID NO: 84141 - DNA, 15 bp, Artificial Sequence
  dgRNA
  __NTC
agtcgtaagggacga

SEQ ID NO: 84142 - DNA, 15 bp, Artificial Sequence
  dgRNA
  __NTC
tccgcgagaggctcg

SEQ ID NO: 84143 - DNA, 15 bp, Artificial Sequence
  dgRNA
  __NTC
ttaccgcactcgact

SEQ ID NO: 84144 - DNA, 15 bp, Artificial Sequence
  dgRNA
  __NTC
aaccccgtacgtcta

SEQ ID NO: 84145 - DNA, 15 bp, Artificial Sequence
  dgRNA
  __NTC
ttcgactggcgttac

SEQ ID NO: 84146 - DNA, 15 bp, Artificial Sequence
  dgRNA
  __NTC
tagcgtacggtggcc

SEQ ID NO: 84147 - DNA, 15 bp, Artificial Sequence
  dgRNA
  __NTC
gttggctcggtaccg

SEQ ID NO: 84148 - DNA, 15 bp, Artificial Sequence
  dgRNA
  __NTC
ccgtacaaaccggct

SEQ ID NO: 84149 - DNA, 15 bp, Artificial Sequence
  dgRNA
  __NTC
cgcaatattaaacgg

SEQ ID NO: 84150 - DNA, 15 bp, Artificial Sequence
  dgRNA
  __NTC
agatagtgcgcggtt

SEQ ID NO: 84151 - DNA, 15 bp, Artificial Sequence
  dgRNA
  __NTC
acgaatcggctttac

SEQ ID NO: 84152 - DNA, 15 bp, Artificial Sequence
  dgRNA
  __NTC
gcgggtctgacgcgg

SEQ ID NO: 84153 - DNA, 15 bp, Artificial Sequence
  dgRNA
  __NTC
cccaactcgatgcga

SEQ ID NO: 84154 - DNA, 15 bp, Artificial Sequence
  dgRNA
  __NTC
ccgatcatgcggagc

SEQ ID NO: 84155 - DNA, 15 bp, Artificial Sequence
  dgRNA
  __NTC
accttacggaacggt

SEQ ID NO: 84156 - DNA, 15 bp, Artificial Sequence
  dgRNA
  __NTC
gcgtaccgcccagga

SEQ ID NO: 84157 - DNA, 15 bp, Artificial Sequence
  dgRNA
  __NTC
tcgatcgaaggggga

SEQ ID NO: 84158 - DNA, 15 bp, Artificial Sequence
  dgRNA
  __NTC
cgaaacccgttacac

SEQ ID NO: 84159 - DNA, 15 bp, Artificial Sequence
  dgRNA
  __NTC
aatatcgaccgcaat

SEQ ID NO: 84160 - DNA, 15 bp, Artificial Sequence
  dgRNA
  __NTC
aacggtttacgggag

SEQ ID NO: 84161 - DNA, 15 bp, Artificial Sequence
  dgRNA
  __NTC
aggcgttgatcgtta

SEQ ID NO: 84162 - DNA, 15 bp, Artificial Sequence
  dgRNA
  __NTC
atcgcatctattcgc

SEQ ID NO: 84163 - DNA, 15 bp, Artificial Sequence
  dgRNA
  __NTC
tggtctagccgcgga

SEQ ID NO: 84164 - DNA, 15 bp, Artificial Sequence
  dgRNA
  __NTC
gcattggtcgggccg

SEQ ID NO: 84165 - DNA, 15 bp, Artificial Sequence
  dgRNA
  __NTC
acggggtgcgttcat

SEQ ID NO: 84166 - DNA, 15 bp, Artificial Sequence
  dgRNA
  __NTC
ggtcctacgcgaaaa

SEQ ID NO: 84167 - DNA, 15 bp, Artificial Sequence
  dgRNA
  __NTC
cggacgcagcttaat

SEQ ID NO: 84168 - DNA, 15 bp, Artificial Sequence
  dgRNA
  __NTC
tcgcgagtaacaagg

SEQ ID NO: 84169 - DNA, 15 bp, Artificial Sequence
  dgRNA
  __NTC
aacggcccgaattta

SEQ ID NO: 84170 - DNA, 15 bp, Artificial Sequence
  dgRNA
  __NTC
ggcgcattgcgctca

SEQ ID NO: 84171 - DNA, 15 bp, Artificial Sequence
  dgRNA
  __NTC
agtctgatacgcgga

SEQ ID NO: 84172 - DNA, 15 bp, Artificial Sequence
  dgRNA
  __NTC
cactccgttgcgatt

SEQ ID NO: 84173 - DNA, 15 bp, Artificial Sequence
  dgRNA
  __NTC
agcctcgttatggcg

SEQ ID NO: 84174 - DNA, 15 bp, Artificial Sequence
  dgRNA
  __NTC
cgtaaacagatccgc

SEQ ID NO: 84175 - DNA, 15 bp, Artificial Sequence
  dgRNA
  __NTC
tcggtgatacccgtt

SEQ ID NO: 84176 - DNA, 15 bp, Artificial Sequence
  dgRNA
  __NTC
atggccgataccgtg

SEQ ID NO: 84177 - DNA, 15 bp, Artificial Sequence
  dgRNA
  __NTC
ggcgtgcaatcctcg

SEQ ID NO: 84178 - DNA, 15 bp, Artificial Sequence
  dgRNA
  __NTC
accggctgtagcgca

SEQ ID NO: 84179 - DNA, 15 bp, Artificial Sequence
  dgRNA
  __NTC
aggcaagtcgtacgg

SEQ ID NO: 84180 - DNA, 15 bp, Artificial Sequence
  dgRNA
  __NTC
catagatcgtcgaca

SEQ ID NO: 84181 - DNA, 15 bp, Artificial Sequence
  dgRNA
  __NTC
gccgcgcaattactg

SEQ ID NO: 84182 - DNA, 15 bp, Artificial Sequence
  dgRNA
  __NTC
tttcgtagcggggga

SEQ ID NO: 84183 - DNA, 15 bp, Artificial Sequence
  dgRNA
  __NTC
acgagcaatctaacg

SEQ ID NO: 84184 - DNA, 15 bp, Artificial Sequence
  dgRNA
  __NTC
cagatcgctagtgcg

SEQ ID NO: 84185 - DNA, 15 bp, Artificial Sequence
  dgRNA
  __NTC
ttagcccgcgtagca

SEQ ID NO: 84186 - DNA, 15 bp, Artificial Sequence
  dgRNA
  __NTC
aatgcgtgtagccgc

SEQ ID NO: 84187 - DNA, 15 bp, Artificial Sequence
  dgRNA
  __NTC
gattagaacgtgcgc

SEQ ID NO: 84188 - DNA, 15 bp, Artificial Sequence
  dgRNA
  __NTC
catacgacggaacca

SEQ ID NO: 84189 - DNA, 15 bp, Artificial Sequence
  dgRNA
  __NTC
tactcgcgtagatgc

SEQ ID NO: 84190 - DNA, 15 bp, Artificial Sequence
  dgRNA
  __NTC
gttaaaagtgcggcg

SEQ ID NO: 84191 - DNA, 15 bp, Artificial Sequence
  dgRNA
  __NTC
cgcactgatagccgc

SEQ ID NO: 84192 - DNA, 15 bp, Artificial Sequence
  dgRNA
  __NTC
tagcgaatgtcggtt

SEQ ID NO: 84193 - DNA, 15 bp, Artificial Sequence
  dgRNA
  __NTC
tacccgctaagcgtc

SEQ ID NO: 84194 - DNA, 15 bp, Artificial Sequence
  dgRNA
  __NTC
acaattgcgtcacgg

SEQ ID NO: 84195 - DNA, 15 bp, Artificial Sequence
  dgRNA
  __NTC
agtcggctagcgttc

SEQ ID NO: 84196 - DNA, 15 bp, Artificial Sequence
  dgRNA
  __NTC
gcccgtacatgccgg

SEQ ID NO: 84197 - DNA, 15 bp, Artificial Sequence
  dgRNA
  __NTC
accatcgtcggacca

SEQ ID NO: 84198 - DNA, 15 bp, Artificial Sequence
  dgRNA
  __NTC
tacacgtccgaggta

SEQ ID NO: 84199 - DNA, 15 bp, Artificial Sequence
  dgRNA
  __NTC
ggggtccgccggttc

SEQ ID NO: 84200 - DNA, 15 bp, Artificial Sequence
  dgRNA
  __NTC
ctcggaattgtccgg

SEQ ID NO: 84201 - DNA, 15 bp, Artificial Sequence
  dgRNA
  __NTC
gcgcgtagacagtag

SEQ ID NO: 84202 - DNA, 15 bp, Artificial Sequence
  dgRNA
  __NTC
gcgcccagtaccgtc

SEQ ID NO: 84203 - DNA, 15 bp, Artificial Sequence
  dgRNA
  __NTC
ttttacgctcgcagg

SEQ ID NO: 84204 - DNA, 15 bp, Artificial Sequence
  dgRNA
  __NTC
cgagagcgtatgatc

SEQ ID NO: 84205 - DNA, 15 bp, Artificial Sequence
  dgRNA
  __NTC
aaccggtgaggcggt

SEQ ID NO: 84206 - DNA, 15 bp, Artificial Sequence
  dgRNA
  __NTC
atatcccgacattcg

SEQ ID NO: 84207 - DNA, 15 bp, Artificial Sequence
  dgRNA
  __NTC
ttgcgtaggcctcgt

SEQ ID NO: 84208 - DNA, 15 bp, Artificial Sequence
  dgRNA
  __NTC
ccctacgagcgtctt

SEQ ID NO: 84209 - DNA, 15 bp, Artificial Sequence
  dgRNA
  __NTC
ataacgcaacccgtg

SEQ ID NO: 84210 - DNA, 15 bp, Artificial Sequence
  dgRNA
  __NTC
atccgcgtatggtag

SEQ ID NO: 84211 - DNA, 15 bp, Artificial Sequence
  dgRNA
  __NTC
cggaagcgtagaccc

SEQ ID NO: 84212 - DNA, 15 bp, Artificial Sequence
  dgRNA
  __NTC
gtaatacgaacgata

SEQ ID NO: 84213 - DNA, 15 bp, Artificial Sequence
  dgRNA
  __NTC
acgtagtgacccgct

SEQ ID NO: 84214 - DNA, 15 bp, Artificial Sequence
  dgRNA
  __NTC
cgagcggttattctt

SEQ ID NO: 84215 - DNA, 15 bp, Artificial Sequence
  dgRNA
  __NTC
ccgggcaggtcgtcg

SEQ ID NO: 84216 - DNA, 15 bp, Artificial Sequence
  dgRNA
  __NTC
gccgacggctcaaat

SEQ ID NO: 84217 - DNA, 15 bp, Artificial Sequence
  dgRNA
  __NTC
cgatgccgcttagat

SEQ ID NO: 84218 - DNA, 15 bp, Artificial Sequence
  dgRNA
  __NTC
acaagtgccgggtcg

SEQ ID NO: 84219 - DNA, 15 bp, Artificial Sequence
  dgRNA
  __NTC
gtgctcgttggcgac

SEQ ID NO: 84220 - DNA, 15 bp, Artificial Sequence
  dgRNA
  __NTC
atcaaccgaactcgt

SEQ ID NO: 84221 - DNA, 15 bp, Artificial Sequence
  dgRNA
  __NTC
cgctcgccgctcgag

SEQ ID NO: 84222 - DNA, 15 bp, Artificial Sequence
  dgRNA
  __NTC
cctacggataagcgt

SEQ ID NO: 84223 - DNA, 15 bp, Artificial Sequence
  dgRNA
  __NTC
gcgtccacgatactt

SEQ ID NO: 84224 - DNA, 15 bp, Artificial Sequence
  dgRNA
  __NTC
gaaaccgcgattgta

SEQ ID NO: 84225 - DNA, 15 bp, Artificial Sequence
  dgRNA
  __NTC
cttaaatcgcgacca

SEQ ID NO: 84226 - DNA, 15 bp, Artificial Sequence
  dgRNA
  __NTC
tgatagaaccgtcga

SEQ ID NO: 84227 - DNA, 15 bp, Artificial Sequence
  dgRNA
  __NTC
agctcggttgcgatc

SEQ ID NO: 84228 - DNA, 15 bp, Artificial Sequence
  dgRNA
  __NTC
tttagcgttcgggca

SEQ ID NO: 84229 - DNA, 15 bp, Artificial Sequence
  dgRNA
  __NTC
ccggcgcgtgtccac

SEQ ID NO: 84230 - DNA, 15 bp, Artificial Sequence
  dgRNA
  __NTC
ccgagggtattcgca

SEQ ID NO: 84231 - DNA, 15 bp, Artificial Sequence
  dgRNA
  __NTC
catcgctcgtactta

SEQ ID NO: 84232 - DNA, 15 bp, Artificial Sequence
  dgRNA
  __NTC
tatcactcgcccggg

SEQ ID NO: 84233 - DNA, 15 bp, Artificial Sequence
  dgRNA
  __NTC
cgcgcgtccatgggt

SEQ ID NO: 84234 - DNA, 15 bp, Artificial Sequence
  dgRNA
  __NTC
gtgcccgcgcagtaa

SEQ ID NO: 84235 - DNA, 15 bp, Artificial Sequence
  dgRNA
  __NTC
catacgagcgtaaca

SEQ ID NO: 84236 - DNA, 15 bp, Artificial Sequence
  dgRNA
  __NTC
tacgcgctgcaataa

SEQ ID NO: 84237 - DNA, 15 bp, Artificial Sequence
  dgRNA
  __NTC
atgtcgagttgcggt

SEQ ID NO: 84238 - DNA, 15 bp, Artificial Sequence
  dgRNA
  __NTC
acgcattatatgcgc

SEQ ID NO: 84239 - DNA, 15 bp, Artificial Sequence
  dgRNA
  __NTC
gcgcgatgcagagcg

SEQ ID NO: 84240 - DNA, 15 bp, Artificial Sequence
  dgRNA
  __NTC
gcgtctaacagcggt

SEQ ID NO: 84241 - DNA, 15 bp, Artificial Sequence
  dgRNA
  __NTC
aattaggatacgccg

SEQ ID NO: 84242 - DNA, 15 bp, Artificial Sequence
  dgRNA
  __NTC
cgttggtatgtacga

SEQ ID NO: 84243 - DNA, 15 bp, Artificial Sequence
  dgRNA
  __NTC
tggcggtactcggat

SEQ ID NO: 84244 - DNA, 15 bp, Artificial Sequence
  dgRNA
  __NTC
atatcatcgcgttac

SEQ ID NO: 84245 - DNA, 15 bp, Artificial Sequence
  dgRNA
  __NTC
tgcgctaaggtccga

SEQ ID NO: 84246 - DNA, 15 bp, Artificial Sequence
  dgRNA
  __NTC
cgctcataaaccggg

SEQ ID NO: 84247 - DNA, 15 bp, Artificial Sequence
  dgRNA
  __NTC
tctagacgaacggta

SEQ ID NO: 84248 - DNA, 15 bp, Artificial Sequence
  dgRNA
  __NTC
ccgcatgagcggggg

SEQ ID NO: 84249 - DNA, 15 bp, Artificial Sequence
  dgRNA
  __NTC
tgcctaccgccgcta

SEQ ID NO: 84250 - DNA, 15 bp, Artificial Sequence
  dgRNA
  __NTC
acttaggcgtctcgc

SEQ ID NO: 84251 - DNA, 15 bp, Artificial Sequence
  dgRNA
  __NTC
gagagtagcgcggtc

SEQ ID NO: 84252 - DNA, 15 bp, Artificial Sequence
  dgRNA
  __NTC
acgagcccgttgcac

SEQ ID NO: 84253 - DNA, 15 bp, Artificial Sequence
  dgRNA
  __NTC
gcggaacgtcatgag

SEQ ID NO: 84254 - DNA, 15 bp, Artificial Sequence
  dgRNA
  __NTC
accgcttgtcggcat

SEQ ID NO: 84255 - DNA, 15 bp, Artificial Sequence
  dgRNA
  __NTC
tgatatcgtacgctt

SEQ ID NO: 84256 - DNA, 15 bp, Artificial Sequence
  dgRNA
  __NTC
tctcgtgatcaaccg

SEQ ID NO: 84257 - DNA, 15 bp, Artificial Sequence
  dgRNA
  __NTC
ctcgacgcccttaag

SEQ ID NO: 84258 - DNA, 15 bp, Artificial Sequence
  dgRNA
  __NTC
ttacgagccccgatg

SEQ ID NO: 84259 - DNA, 15 bp, Artificial Sequence
  dgRNA
  __NTC
cgacctacgaaggtt

SEQ ID NO: 84260 - DNA, 15 bp, Artificial Sequence
  dgRNA
  __NTC
ttgatgcacgatgcg

SEQ ID NO: 84261 - DNA, 15 bp, Artificial Sequence
  dgRNA
  __NTC
ccagtacgctacgtg

SEQ ID NO: 84262 - DNA, 15 bp, Artificial Sequence
  dgRNA
  __NTC
tgcgcgaacttagag

SEQ ID NO: 84263 - DNA, 15 bp, Artificial Sequence
  dgRNA
  __NTC
tcccgatttcgcaac

SEQ ID NO: 84264 - DNA, 15 bp, Artificial Sequence
  dgRNA
  __NTC
gttagtcgatccccc

SEQ ID NO: 84265 - DNA, 15 bp, Artificial Sequence
  dgRNA
  __NTC
cgcaacgtgggtacc

SEQ ID NO: 84266 - DNA, 15 bp, Artificial Sequence
  dgRNA
  __NTC
cggtcggtgatcaat

SEQ ID NO: 84267 - DNA, 15 bp, Artificial Sequence
  dgRNA
  __NTC
ttcggtgccgatagt

SEQ ID NO: 84268 - DNA, 15 bp, Artificial Sequence
  dgRNA
  __NTC
ttagcggtttgcggt

SEQ ID NO: 84269 - DNA, 15 bp, Artificial Sequence
  dgRNA
  __NTC
cgttaacgtagcagg

SEQ ID NO: 84270 - DNA, 15 bp, Artificial Sequence
  dgRNA
  __NTC
gttaagtacgcgctt

SEQ ID NO: 84271 - DNA, 15 bp, Artificial Sequence
  dgRNA
  __NTC
cggacgggggatgcg

SEQ ID NO: 84272 - DNA, 15 bp, Artificial Sequence
  dgRNA
  __NTC
aggacggcccgctag

SEQ ID NO: 84273 - DNA, 15 bp, Artificial Sequence
  dgRNA
  __NTC
cgggtagcaaaacgg

SEQ ID NO: 84274 - DNA, 15 bp, Artificial Sequence
  dgRNA
  __NTC
cgcggttggcataca

SEQ ID NO: 84275 - DNA, 15 bp, Artificial Sequence
  dgRNA
  __NTC
ctacgtcattacgct

SEQ ID NO: 84276 - DNA, 15 bp, Artificial Sequence
  dgRNA
  __NTC
tggttaacgccggag

SEQ ID NO: 84277 - DNA, 15 bp, Artificial Sequence
  dgRNA
  __NTC
gggcgaatcatacga

SEQ ID NO: 84278 - DNA, 15 bp, Artificial Sequence
  dgRNA
  __NTC
taccgtaccgtacta

SEQ ID NO: 84279 - DNA, 15 bp, Artificial Sequence
  dgRNA
  __NTC
caacgaatccgcctc

SEQ ID NO: 84280 - DNA, 15 bp, Artificial Sequence
  dgRNA
  __NTC
tcgatccgaaaaacc

SEQ ID NO: 84281 - DNA, 15 bp, Artificial Sequence
  dgRNA
  __NTC
ggtactccccggcgg

SEQ ID NO: 84282 - DNA, 15 bp, Artificial Sequence
  dgRNA
  __NTC
acgcggaactcagcg

SEQ ID NO: 84283 - DNA, 15 bp, Artificial Sequence
  dgRNA
  __NTC
aagcccttagcgcgc

SEQ ID NO: 84284 - DNA, 15 bp, Artificial Sequence
  dgRNA
  __NTC
taaaccgctcgctaa

SEQ ID NO: 84285 - DNA, 15 bp, Artificial Sequence
  dgRNA
  __NTC
gagtcgcgcaagatg

SEQ ID NO: 84286 - DNA, 15 bp, Artificial Sequence
  dgRNA
  __NTC
agccgcgtccggctt

SEQ ID NO: 84287 - DNA, 15 bp, Artificial Sequence
  dgRNA
  __NTC
tcgaccgatgatata

SEQ ID NO: 84288 - DNA, 15 bp, Artificial Sequence
  dgRNA
  __NTC
tccggaggtatcgga

SEQ ID NO: 84289 - DNA, 15 bp, Artificial Sequence
  dgRNA
  __NTC
attgtcggaagatcg

SEQ ID NO: 84290 - DNA, 15 bp, Artificial Sequence
  dgRNA
  __NTC
gacccacgtgcggta

SEQ ID NO: 84291 - DNA, 15 bp, Artificial Sequence
  dgRNA
  __NTC
acgcgggaagtcgag

SEQ ID NO: 84292 - DNA, 15 bp, Artificial Sequence
  dgRNA
  __NTC
atagctacctcggcg

SEQ ID NO: 84293 - DNA, 15 bp, Artificial Sequence
  dgRNA
  __NTC
tgatatcgcccgagc

SEQ ID NO: 84294 - DNA, 15 bp, Artificial Sequence
  dgRNA
  __NTC
tgatgaaaccggcgc

SEQ ID NO: 84295 - DNA, 15 bp, Artificial Sequence
  dgRNA
  __NTC
tgcgcataggaccgc

SEQ ID NO: 84296 - DNA, 15 bp, Artificial Sequence
  dgRNA
  __NTC
acgatcggacttgga

SEQ ID NO: 84297 - DNA, 15 bp, Artificial Sequence
  dgRNA
  __NTC
tcttcgattgccggc

SEQ ID NO: 84298 - DNA, 15 bp, Artificial Sequence
  dgRNA
  __NTC
cggatccgagcctat

SEQ ID NO: 84299 - DNA, 15 bp, Artificial Sequence
  dgRNA
  __NTC
ctgcggcaccgaccg

SEQ ID NO: 84300 - DNA, 15 bp, Artificial Sequence
  dgRNA
  __NTC
gtgagacgaacgacc

SEQ ID NO: 84301 - DNA, 15 bp, Artificial Sequence
  dgRNA
  __NTC
cgtttcgtattgagc

SEQ ID NO: 84302 - DNA, 15 bp, Artificial Sequence
  dgRNA
  __NTC
ttgagtcgttaccga

SEQ ID NO: 84303 - DNA, 15 bp, Artificial Sequence
  dgRNA
  __NTC
aatacccgcccgttc

SEQ ID NO: 84304 - DNA, 15 bp, Artificial Sequence
  dgRNA
  __NTC
aacgcagatcgagta

SEQ ID NO: 84305 - DNA, 15 bp, Artificial Sequence
  dgRNA
  __NTC
ccgtaagaatcgatc

SEQ ID NO: 84306 - DNA, 15 bp, Artificial Sequence
  dgRNA
  __NTC
agcgcggagctagtt

SEQ ID NO: 84307 - DNA, 15 bp, Artificial Sequence
  dgRNA
  __NTC
cttgtcgaagtagcg

SEQ ID NO: 84308 - DNA, 15 bp, Artificial Sequence
  dgRNA
  __NTC
ggcgtagtctggcgt

SEQ ID NO: 84309 - DNA, 15 bp, Artificial Sequence
  dgRNA
  __NTC
gcgagcgacgaaaca

SEQ ID NO: 84310 - DNA, 15 bp, Artificial Sequence
  dgRNA
  __NTC
cccgggttcgttaat

SEQ ID NO: 84311 - DNA, 15 bp, Artificial Sequence
  dgRNA
  __NTC
atcgccatcggtaca

SEQ ID NO: 84312 - DNA, 15 bp, Artificial Sequence
  dgRNA
  __NTC
atgtgattccgccga

SEQ ID NO: 84313 - DNA, 15 bp, Artificial Sequence
  dgRNA
  __NTC
cgttactcgtttgac

SEQ ID NO: 84314 - DNA, 15 bp, Artificial Sequence
  dgRNA
  __NTC
acgcttcttatgacg

SEQ ID NO: 84315 - DNA, 15 bp, Artificial Sequence
  dgRNA
  __NTC
cacgcagcgttatac

SEQ ID NO: 84316 - DNA, 15 bp, Artificial Sequence
  dgRNA
  __NTC
tttatcggtgcggag

SEQ ID NO: 84317 - DNA, 15 bp, Artificial Sequence
  dgRNA
  __NTC
accgatcgattacaa

SEQ ID NO: 84318 - DNA, 15 bp, Artificial Sequence
  dgRNA
  __NTC
tgttccgatgcgccc

SEQ ID NO: 84319 - DNA, 15 bp, Artificial Sequence
  dgRNA
  __NTC
atcgcgctagactgg

SEQ ID NO: 84320 - DNA, 15 bp, Artificial Sequence
  dgRNA
  __NTC
cgcggcgctgtagcc

SEQ ID NO: 84321 - DNA, 15 bp, Artificial Sequence
  dgRNA
  __NTC
catacgcagggcgta

SEQ ID NO: 84322 - DNA, 15 bp, Artificial Sequence
  dgRNA
  __NTC
gccgttcgagcaaat

SEQ ID NO: 84323 - DNA, 15 bp, Artificial Sequence
  dgRNA
  __NTC
gttgttgcgacaccg

SEQ ID NO: 84324 - DNA, 15 bp, Artificial Sequence
  dgRNA
  __NTC
aggtctacgccgtgc

SEQ ID NO: 84325 - DNA, 15 bp, Artificial Sequence
  dgRNA
  __NTC
tgtttgatcgtacgg

SEQ ID NO: 84326 - DNA, 15 bp, Artificial Sequence
  dgRNA
  __NTC
cgaagtgtacaacgg

SEQ ID NO: 84327 - DNA, 15 bp, Artificial Sequence
  dgRNA
  __NTC
cgcatattctggtcg

SEQ ID NO: 84328 - DNA, 15 bp, Artificial Sequence
  dgRNA
  __NTC
ttgtgttacaacgcg

SEQ ID NO: 84329 - DNA, 15 bp, Artificial Sequence
  dgRNA
  __NTC
atccgccgggacatt

SEQ ID NO: 84330 - DNA, 15 bp, Artificial Sequence
  dgRNA
  __NTC
agccgtatacgacag

SEQ ID NO: 84331 - DNA, 15 bp, Artificial Sequence
  dgRNA
  __NTC
aacggttaccgtatc

SEQ ID NO: 84332 - DNA, 15 bp, Artificial Sequence
  dgRNA
  __NTC
ttttggccgtcgatc

SEQ ID NO: 84333 - DNA, 15 bp, Artificial Sequence
  dgRNA
  __NTC
gctacgtaatcgctc

SEQ ID NO: 84334 - DNA, 15 bp, Artificial Sequence
  dgRNA
  __NTC
taccgcaccgacaaa

SEQ ID NO: 84335 - DNA, 15 bp, Artificial Sequence
  dgRNA
  __NTC
gtattcccgtcgccc

SEQ ID NO: 84336 - DNA, 15 bp, Artificial Sequence
  dgRNA
  __NTC
ctatcgcgcaacaga

SEQ ID NO: 84337 - DNA, 15 bp, Artificial Sequence
  dgRNA
  __NTC
gggagccgcgtctcg

SEQ ID NO: 84338 - DNA, 15 bp, Artificial Sequence
  dgRNA
  __NTC
tcagtctagacggcg

SEQ ID NO: 84339 - DNA, 15 bp, Artificial Sequence
  dgRNA
  __NTC
tcaagcgaccgcata

SEQ ID NO: 84340 - DNA, 15 bp, Artificial Sequence
  dgRNA
  __NTC
gacttcgacgtctag

SEQ ID NO: 84341 - DNA, 15 bp, Artificial Sequence
  dgRNA
  __NTC
tctacacgaccgtaa

SEQ ID NO: 84342 - DNA, 15 bp, Artificial Sequence
  dgRNA
  __NTC
gctgctcgtaagcgg

SEQ ID NO: 84343 - DNA, 15 bp, Artificial Sequence
  dgRNA
  __NTC
atacggttcaccacg

SEQ ID NO: 84344 - DNA, 15 bp, Artificial Sequence
  dgRNA
  __NTC
cgcaagactcaatcg

SEQ ID NO: 84345 - DNA, 15 bp, Artificial Sequence
  dgRNA
  __NTC
gtcgtcgattagcag

SEQ ID NO: 84346 - DNA, 15 bp, Artificial Sequence
  dgRNA
  __NTC
tggcacgcatagcgc

SEQ ID NO: 84347 - DNA, 15 bp, Artificial Sequence
  dgRNA
  __NTC
cgtgtttacggccta

SEQ ID NO: 84348 - DNA, 15 bp, Artificial Sequence
  dgRNA
  __NTC
gtttcgtaggtccgt

SEQ ID NO: 84349 - DNA, 15 bp, Artificial Sequence
  dgRNA
  __NTC
gcggctccggcacta

SEQ ID NO: 84350 - DNA, 15 bp, Artificial Sequence
  dgRNA
  __NTC
cgaaccgcctctaag

SEQ ID NO: 84351 - DNA, 15 bp, Artificial Sequence
  dgRNA
  __NTC
ccgacggggcctgta

SEQ ID NO: 84352 - DNA, 15 bp, Artificial Sequence
  dgRNA
  __NTC
ccgacccgcatgagg

SEQ ID NO: 84353 - DNA, 15 bp, Artificial Sequence
  dgRNA
  __NTC
cggattcccgttagc

SEQ ID NO: 84354 - DNA, 15 bp, Artificial Sequence
  dgRNA
  __NTC
cgtatccgttgtggg

SEQ ID NO: 84355 - DNA, 15 bp, Artificial Sequence
  dgRNA
  __NTC
catctacgacgagta

SEQ ID NO: 84356 - DNA, 15 bp, Artificial Sequence
  dgRNA
  __NTC
acgcaaccggtgaag

SEQ ID NO: 84357 - DNA, 15 bp, Artificial Sequence
  dgRNA
  __NTC
atatatcccgcgtgg

SEQ ID NO: 84358 - DNA, 15 bp, Artificial Sequence
  dgRNA
  __NTC
ccgccttttgcgtat

SEQ ID NO: 84359 - DNA, 15 bp, Artificial Sequence
  dgRNA
  __NTC
gtcgagcgctagctt

SEQ ID NO: 84360 - DNA, 15 bp, Artificial Sequence
  dgRNA
  __NTC
gggcgtacggccatg

SEQ ID NO: 84361 - DNA, 15 bp, Artificial Sequence
  dgRNA
  __NTC
acctgacggcggatt

SEQ ID NO: 84362 - DNA, 15 bp, Artificial Sequence
  dgRNA
  __NTC
cacatcgggttcggg

SEQ ID NO: 84363 - DNA, 15 bp, Artificial Sequence
  dgRNA
  __NTC
cgcaacacgatatct

SEQ ID NO: 84364 - DNA, 15 bp, Artificial Sequence
  dgRNA
  __NTC
ttaagcgacaccgca

SEQ ID NO: 84365 - DNA, 15 bp, Artificial Sequence
  dgRNA
  __NTC
acggcaccggacata

SEQ ID NO: 84366 - DNA, 15 bp, Artificial Sequence
  dgRNA
  __NTC
gcgaatttcgcccat

SEQ ID NO: 84367 - DNA, 15 bp, Artificial Sequence
  dgRNA
  __NTC
ccggcatgaaatcgc

SEQ ID NO: 84368 - DNA, 15 bp, Artificial Sequence
  dgRNA
  __NTC
cgtctattcgcaggt

SEQ ID NO: 84369 - DNA, 15 bp, Artificial Sequence
  dgRNA
  __NTC
tatcggcttccgcca

SEQ ID NO: 84370 - DNA, 15 bp, Artificial Sequence
  dgRNA
  __NTC
tcggttaagttgacg

SEQ ID NO: 84371 - DNA, 15 bp, Artificial Sequence
  dgRNA
  __NTC
gtctcggcggttacc

SEQ ID NO: 84372 - DNA, 15 bp, Artificial Sequence
  dgRNA
  __NTC
tcgtgatccgcatga

SEQ ID NO: 84373 - DNA, 15 bp, Artificial Sequence
  dgRNA
  __NTC
cgacagagccgtacc

SEQ ID NO: 84374 - DNA, 15 bp, Artificial Sequence
  dgRNA
  __NTC
gtcgcaactcacgag

SEQ ID NO: 84375 - DNA, 15 bp, Artificial Sequence
  dgRNA
  __NTC
cttgcgtcgagccac

SEQ ID NO: 84376 - DNA, 15 bp, Artificial Sequence
  dgRNA
  __NTC
cgcaattcacgcagg

SEQ ID NO: 84377 - DNA, 15 bp, Artificial Sequence
  dgRNA
  __NTC
cagattccgatgcgt

SEQ ID NO: 84378 - DNA, 15 bp, Artificial Sequence
  dgRNA
  __NTC
gtttcgccgcaaaga

SEQ ID NO: 84379 - DNA, 15 bp, Artificial Sequence
  dgRNA
  __NTC
ggatatcggcttcgg

SEQ ID NO: 84380 - DNA, 15 bp, Artificial Sequence
  dgRNA
  __NTC
ccgccaccgggcgat

SEQ ID NO: 84381 - DNA, 15 bp, Artificial Sequence
  dgRNA
  __NTC
cgtcaggtgacggtt

SEQ ID NO: 84382 - DNA, 15 bp, Artificial Sequence
  dgRNA
  __NTC
atagacgatcactcg

SEQ ID NO: 84383 - DNA, 15 bp, Artificial Sequence
  dgRNA
  __NTC
caacacgttgcacga

SEQ ID NO: 84384 - DNA, 15 bp, Artificial Sequence
  dgRNA
  __NTC
gtacagaccgcccgc

SEQ ID NO: 84385 - DNA, 15 bp, Artificial Sequence
  dgRNA
  __NTC
aatcggagcgaccct

SEQ ID NO: 84386 - DNA, 15 bp, Artificial Sequence
  dgRNA
  __NTC
gtagcggtgtcggga

SEQ ID NO: 84387 - DNA, 15 bp, Artificial Sequence
  dgRNA
  __NTC
catagtcggtccgat

SEQ ID NO: 84388 - DNA, 15 bp, Artificial Sequence
  dgRNA
  __NTC
caggcgcggtgcgta

SEQ ID NO: 84389 - DNA, 15 bp, Artificial Sequence
  dgRNA
  __NTC
cgagcgagtgtttag

SEQ ID NO: 84390 - DNA, 15 bp, Artificial Sequence
  dgRNA
  __NTC
gtacaagcgtcgctg

SEQ ID NO: 84391 - DNA, 15 bp, Artificial Sequence
  dgRNA
  __NTC
tacggagatgtcggg

SEQ ID NO: 84392 - DNA, 15 bp, Artificial Sequence
  dgRNA
  __NTC
ccgcgagttcaccta

SEQ ID NO: 84393 - DNA, 15 bp, Artificial Sequence
  dgRNA
  __NTC
tcgcggagaccttaa

SEQ ID NO: 84394 - DNA, 15 bp, Artificial Sequence
  dgRNA
  __NTC
ggtgtcgggcttacg

SEQ ID NO: 84395 - DNA, 15 bp, Artificial Sequence
  dgRNA
  __NTC
gacgtgggcgatatc

SEQ ID NO: 84396 - DNA, 15 bp, Artificial Sequence
  dgRNA
  __NTC
tacgttctagccgca

SEQ ID NO: 84397 - DNA, 15 bp, Artificial Sequence
  dgRNA
  __NTC
tcgggcgtcaatcac

SEQ ID NO: 84398 - DNA, 15 bp, Artificial Sequence
  dgRNA
  __NTC
tcgtatacggttgtg

SEQ ID NO: 84399 - DNA, 15 bp, Artificial Sequence
  dgRNA
  __NTC
attactgcgtcgcta

SEQ ID NO: 84400 - DNA, 15 bp, Artificial Sequence
  dgRNA
  __NTC
ctatgaacggcgagt

SEQ ID NO: 84401 - DNA, 15 bp, Artificial Sequence
  dgRNA
  __NTC
gctcacgatacgatg

SEQ ID NO: 84402 - DNA, 15 bp, Artificial Sequence
  dgRNA
  __NTC
gcgtatggttgacgt

SEQ ID NO: 84403 - DNA, 15 bp, Artificial Sequence
  dgRNA
  __NTC
gttgcataaacgcgt

SEQ ID NO: 84404 - DNA, 15 bp, Artificial Sequence
  dgRNA
  __NTC
tttgggttcgcgagc

SEQ ID NO: 84405 - DNA, 15 bp, Artificial Sequence
  dgRNA
  __NTC
cacggccgggtcata

SEQ ID NO: 84406 - DNA, 15 bp, Artificial Sequence
  dgRNA
  __NTC
cctggcgtcgcacta

SEQ ID NO: 84407 - DNA, 15 bp, Artificial Sequence
  dgRNA
  __NTC
ttcgctccggtttac

SEQ ID NO: 84408 - DNA, 15 bp, Artificial Sequence
  dgRNA
  __NTC
taactctcatgcgcg

SEQ ID NO: 84409 - DNA, 15 bp, Artificial Sequence
  dgRNA
  __NTC
atacgtcgtgtgtta

SEQ ID NO: 84410 - DNA, 15 bp, Artificial Sequence
  dgRNA
  __NTC
gacgggcatcgcggt

SEQ ID NO: 84411 - DNA, 15 bp, Artificial Sequence
  dgRNA
  __NTC
gcgacttgcgtctgg

SEQ ID NO: 84412 - DNA, 15 bp, Artificial Sequence
  dgRNA
  __NTC
ctagcctttacgtcg

SEQ ID NO: 84413 - DNA, 15 bp, Artificial Sequence
  dgRNA
  __NTC
tcccgatcacgtagc

SEQ ID NO: 84414 - DNA, 15 bp, Artificial Sequence
  dgRNA
  __NTC
acacctttcggcgtc

SEQ ID NO: 84415 - DNA, 15 bp, Artificial Sequence
  dgRNA
  __NTC
ttagcccactcgcgt

SEQ ID NO: 84416 - DNA, 15 bp, Artificial Sequence
  dgRNA
  __NTC
ctcggctcaaatacg

SEQ ID NO: 84417 - DNA, 15 bp, Artificial Sequence
  dgRNA
  __NTC
agttatcaacgccga

SEQ ID NO: 84418 - DNA, 15 bp, Artificial Sequence
  dgRNA
  __NTC
tcccttataacgtcg

SEQ ID NO: 84419 - DNA, 15 bp, Artificial Sequence
  dgRNA
  __NTC
tgctggtacggcccg

SEQ ID NO: 84420 - DNA, 15 bp, Artificial Sequence
  dgRNA
  __NTC
cgtacgtctaagtaa

SEQ ID NO: 84421 - DNA, 15 bp, Artificial Sequence
  dgRNA
  __NTC
atagctatgcgcacg

SEQ ID NO: 84422 - DNA, 15 bp, Artificial Sequence
  dgRNA
  __NTC
gcgtaagtttctcgt

SEQ ID NO: 84423 - DNA, 15 bp, Artificial Sequence
  dgRNA
  __NTC
tacccgtgaattacg

SEQ ID NO: 84424 - DNA, 15 bp, Artificial Sequence
  dgRNA
  __NTC
tttacttgtaacgcg

SEQ ID NO: 84425 - DNA, 15 bp, Artificial Sequence
  dgRNA
  __NTC
atacgggttcgaaat

SEQ ID NO: 84426 - DNA, 15 bp, Artificial Sequence
  dgRNA
  __NTC
atgcggtaacagcgt

SEQ ID NO: 84427 - DNA, 15 bp, Artificial Sequence
  dgRNA
  __NTC
ctcgtacgtgaggca

SEQ ID NO: 84428 - DNA, 15 bp, Artificial Sequence
  dgRNA
  __NTC
cgccgtacagacaat

SEQ ID NO: 84429 - DNA, 15 bp, Artificial Sequence
  dgRNA
  __NTC
cgcattcatcgggat

SEQ ID NO: 84430 - DNA, 15 bp, Artificial Sequence
  dgRNA
  __NTC
tcctagtaaccgcga

SEQ ID NO: 84431 - DNA, 15 bp, Artificial Sequence
  dgRNA
  __NTC
cggacacgtagtgct

SEQ ID NO: 84432 - DNA, 15 bp, Artificial Sequence
  dgRNA
  __NTC
ggcgatcgtgatcaa

SEQ ID NO: 84433 - DNA, 15 bp, Artificial Sequence
  dgRNA
  __NTC
tcggacgttgcttgc

SEQ ID NO: 84434 - DNA, 15 bp, Artificial Sequence
  dgRNA
  __NTC
ttaatcgtccgcttg

SEQ ID NO: 84435 - DNA, 15 bp, Artificial Sequence
  dgRNA
  __NTC
aatgcgcgcacacgg

SEQ ID NO: 84436 - DNA, 15 bp, Artificial Sequence
  dgRNA
  __NTC
ggccggaactgccgt

SEQ ID NO: 84437 - DNA, 15 bp, Artificial Sequence
  dgRNA
  __NTC
gaaagtcgcgaattg

SEQ ID NO: 84438 - DNA, 15 bp, Artificial Sequence
  dgRNA
  __NTC
tccgacaccttgcgt

SEQ ID NO: 84439 - DNA, 15 bp, Artificial Sequence
  dgRNA
  __NTC
tcgcgcataattcta

SEQ ID NO: 84440 - DNA, 15 bp, Artificial Sequence
  dgRNA
  __NTC
aatggtgcgaaccgg

SEQ ID NO: 84441 - DNA, 15 bp, Artificial Sequence
  dgRNA
  __NTC
ggcacgcagtaccga

SEQ ID NO: 84442 - DNA, 15 bp, Artificial Sequence
  dgRNA
  __NTC
gtgcgccccagcgta

SEQ ID NO: 84443 - DNA, 15 bp, Artificial Sequence
  dgRNA
  __NTC
gcgtaccacgaggac

SEQ ID NO: 84444 - DNA, 15 bp, Artificial Sequence
  dgRNA
  __NTC
acgccccgttgatgt

SEQ ID NO: 84445 - DNA, 15 bp, Artificial Sequence
  dgRNA
  __NTC
agtaacatcgtacgg

SEQ ID NO: 84446 - DNA, 15 bp, Artificial Sequence
  dgRNA
  __NTC
acacgcaccgggacg

SEQ ID NO: 84447 - DNA, 15 bp, Artificial Sequence
  dgRNA
  __NTC
gactctacggcacgg

SEQ ID NO: 84448 - DNA, 15 bp, Artificial Sequence
  dgRNA
  __NTC
atcgatgtaaatccg

SEQ ID NO: 84449 - DNA, 15 bp, Artificial Sequence
  dgRNA
  __NTC
gtgtcgatgcgggtt

SEQ ID NO: 84450 - DNA, 15 bp, Artificial Sequence
  dgRNA
  __NTC
cctcattgcggctcg

SEQ ID NO: 84451 - DNA, 15 bp, Artificial Sequence
  dgRNA
  __NTC
taacgagacacccgc

SEQ ID NO: 84452 - DNA, 15 bp, Artificial Sequence
  dgRNA
  __NTC
gggggcgttcgtcac

SEQ ID NO: 84453 - DNA, 15 bp, Artificial Sequence
  dgRNA
  __NTC
gcggcgcactcagat

SEQ ID NO: 84454 - DNA, 15 bp, Artificial Sequence
  dgRNA
  __NTC
cgggcgagcgagtaa

SEQ ID NO: 84455 - DNA, 15 bp, Artificial Sequence
  dgRNA
  __NTC
aacctctcgaagcga

SEQ ID NO: 84456 - DNA, 15 bp, Artificial Sequence
  dgRNA
  __NTC
acattaatcccgccg

SEQ ID NO: 84457 - DNA, 15 bp, Artificial Sequence
  dgRNA
  __NTC
atgatggtgcgcgaa

SEQ ID NO: 84458 - DNA, 15 bp, Artificial Sequence
  dgRNA
  __NTC
tactttgcgccgtgg

SEQ ID NO: 84459 - DNA, 15 bp, Artificial Sequence
  dgRNA
  __NTC
atggggtcgtcgtgc

SEQ ID NO: 84460 - DNA, 15 bp, Artificial Sequence
  dgRNA
  __NTC
caagtagcggagcga

SEQ ID NO: 84461 - DNA, 15 bp, Artificial Sequence
  dgRNA
  __NTC
ggttgagttccgcgc

SEQ ID NO: 84462 - DNA, 15 bp, Artificial Sequence
  dgRNA
  __NTC
actcggcgctctagt

SEQ ID NO: 84463 - DNA, 15 bp, Artificial Sequence
  dgRNA
  __NTC
gcgccttaaaacgaa

SEQ ID NO: 84464 - DNA, 15 bp, Artificial Sequence
  dgRNA
  __NTC
gcgacttacgggttt

SEQ ID NO: 84465 - DNA, 15 bp, Artificial Sequence
  dgRNA
  __NTC
aatctgcgatcgaat

SEQ ID NO: 84466 - DNA, 15 bp, Artificial Sequence
  dgRNA
  __NTC
acgatcgtcagatgc

SEQ ID NO: 84467 - DNA, 15 bp, Artificial Sequence
  dgRNA
  __NTC
gcgcgcctcgtgact

SEQ ID NO: 84468 - DNA, 15 bp, Artificial Sequence
  dgRNA
  __NTC
gcgacaatagcgaga

SEQ ID NO: 84469 - DNA, 15 bp, Artificial Sequence
  dgRNA
  __NTC
ccagcgaccgcgaag

SEQ ID NO: 84470 - DNA, 15 bp, Artificial Sequence
  dgRNA
  __NTC
cacggatcgtactct

SEQ ID NO: 84471 - DNA, 15 bp, Artificial Sequence
  dgRNA
  __NTC
ccacggttgacgctc

SEQ ID NO: 84472 - DNA, 15 bp, Artificial Sequence
  dgRNA
  __NTC
aggccgtccaaacgc

SEQ ID NO: 84473 - DNA, 15 bp, Artificial Sequence
  dgRNA
  __NTC
tgttcgtaccgcaaa

SEQ ID NO: 84474 - DNA, 15 bp, Artificial Sequence
  dgRNA
  __NTC
tatggccagcgggcg

SEQ ID NO: 84475 - DNA, 15 bp, Artificial Sequence
  dgRNA
  __NTC
acgcatccagcgcaa

SEQ ID NO: 84476 - DNA, 15 bp, Artificial Sequence
  dgRNA
  __NTC
gcccgctgcgaatcc

SEQ ID NO: 84477 - DNA, 15 bp, Artificial Sequence
  dgRNA
  __NTC
tttcgcacgtagact

SEQ ID NO: 84478 - DNA, 15 bp, Artificial Sequence
  dgRNA
  __NTC
gaatcgtccccgtca

SEQ ID NO: 84479 - DNA, 15 bp, Artificial Sequence
  dgRNA
  __NTC
tgtactacgagcacg

SEQ ID NO: 84480 - DNA, 15 bp, Artificial Sequence
  dgRNA
  __NTC
cgttggatcgaaacc

SEQ ID NO: 84481 - DNA, 15 bp, Artificial Sequence
  dgRNA
  __NTC
acagtggtccgcgcg

SEQ ID NO: 84482 - DNA, 15 bp, Artificial Sequence
  dgRNA
  __NTC
tgctcgtactcgggt

SEQ ID NO: 84483 - DNA, 15 bp, Artificial Sequence
  dgRNA
  __NTC
cgatcgctgttaaag

SEQ ID NO: 84484 - DNA, 15 bp, Artificial Sequence
  dgRNA
  __NTC
tgattgagcggagcg

SEQ ID NO: 84485 - DNA, 15 bp, Artificial Sequence
  dgRNA
  __NTC
ctttagtaccggcga

SEQ ID NO: 84486 - DNA, 15 bp, Artificial Sequence
  dgRNA
  __NTC
tacgcagtctccgat

SEQ ID NO: 84487 - DNA, 15 bp, Artificial Sequence
  dgRNA
  __NTC
cgtcagcgttcctcg

SEQ ID NO: 84488 - DNA, 15 bp, Artificial Sequence
  dgRNA
  __NTC
ctgtcgtataccgag

SEQ ID NO: 84489 - DNA, 15 bp, Artificial Sequence
  dgRNA
  __NTC
catacgttgatgccg

SEQ ID NO: 84490 - DNA, 15 bp, Artificial Sequence
  dgRNA
  __NTC
acgtcttttaaccgc

SEQ ID NO: 84491 - DNA, 15 bp, Artificial Sequence
  dgRNA
  __NTC
gcacggtcgtatgaa

SEQ ID NO: 84492 - DNA, 15 bp, Artificial Sequence
  dgRNA
  __NTC
acgtgttctcgtgcg

SEQ ID NO: 84493 - DNA, 15 bp, Artificial Sequence
  dgRNA
  __NTC
tccgtatccgaatgc

SEQ ID NO: 84494 - DNA, 15 bp, Artificial Sequence
  dgRNA
  __NTC
ccgtggattcatacg

SEQ ID NO: 84495 - DNA, 15 bp, Artificial Sequence
  dgRNA
  __NTC
atccgtaggcactcg

SEQ ID NO: 84496 - DNA, 15 bp, Artificial Sequence
  dgRNA
  __NTC
ccgaatagagagcgt

SEQ ID NO: 84497 - DNA, 15 bp, Artificial Sequence
  dgRNA
  __NTC
cagtgcgttatcgct

SEQ ID NO: 84498 - DNA, 15 bp, Artificial Sequence
  dgRNA
  __NTC
gagacgcaagatacg

SEQ ID NO: 84499 - DNA, 15 bp, Artificial Sequence
  dgRNA
  __NTC
ggtgaaccgacggag

SEQ ID NO: 84500 - DNA, 15 bp, Artificial Sequence
  dgRNA
  __NTC
ttagtgcccgcgtta

SEQ ID NO: 84501 - DNA, 15 bp, Artificial Sequence
  dgRNA
  __NTC
cgcaagagtcgattc

SEQ ID NO: 84502 - DNA, 15 bp, Artificial Sequence
  dgRNA
  __NTC
aacatcctacgcgag

SEQ ID NO: 84503 - DNA, 15 bp, Artificial Sequence
  dgRNA
  __NTC
cgatcgcctactcct

SEQ ID NO: 84504 - DNA, 15 bp, Artificial Sequence
  dgRNA
  __NTC
cccggatatcgcaca

SEQ ID NO: 84505 - DNA, 15 bp, Artificial Sequence
  dgRNA
  __NTC
agatgcgacgtccac

SEQ ID NO: 84506 - DNA, 15 bp, Artificial Sequence
  dgRNA
  __NTC
cgaggccaagcgtaa

SEQ ID NO: 84507 - DNA, 15 bp, Artificial Sequence
  dgRNA
  __NTC
gagtggtgtcgcgcc

SEQ ID NO: 84508 - DNA, 15 bp, Artificial Sequence
  dgRNA
  __NTC
atatcgactcaacgt

SEQ ID NO: 84509 - DNA, 15 bp, Artificial Sequence
  dgRNA
  __NTC
gaactcgctaacgag

SEQ ID NO: 84510 - DNA, 15 bp, Artificial Sequence
  dgRNA
  __NTC
caagaagtcgatacg

SEQ ID NO: 84511 - DNA, 15 bp, Artificial Sequence
  dgRNA
  __NTC
gcatggccgcgcggc

SEQ ID NO: 84512 - DNA, 15 bp, Artificial Sequence
  dgRNA
  __NTC
tagcgcgaacagagg

SEQ ID NO: 84513 - DNA, 15 bp, Artificial Sequence
  dgRNA
  __NTC
atgcgtgatcgccat

SEQ ID NO: 84514 - DNA, 15 bp, Artificial Sequence
  dgRNA
  __NTC
atataccgggacacg

SEQ ID NO: 84515 - DNA, 15 bp, Artificial Sequence
  dgRNA
  __NTC
caaacaacgtggcgc

SEQ ID NO: 84516 - DNA, 15 bp, Artificial Sequence
  dgRNA
  __NTC
aacgccgtcaagtaa

SEQ ID NO: 84517 - DNA, 15 bp, Artificial Sequence
  dgRNA
  __NTC
cgattcgagcccatg

SEQ ID NO: 84518 - DNA, 15 bp, Artificial Sequence
  dgRNA
  __NTC
ggctccgcacgaaac

SEQ ID NO: 84519 - DNA, 15 bp, Artificial Sequence
  dgRNA
  __NTC
caacggcggaatata

SEQ ID NO: 84520 - DNA, 15 bp, Artificial Sequence
  dgRNA
  __NTC
cggggcccgtttgcc

SEQ ID NO: 84521 - DNA, 15 bp, Artificial Sequence
  dgRNA
  __NTC
actacgccggacttc

SEQ ID NO: 84522 - DNA, 15 bp, Artificial Sequence
  dgRNA
  __NTC
ttcggtccgcaaacc

SEQ ID NO: 84523 - DNA, 15 bp, Artificial Sequence
  dgRNA
  __NTC
tgcagcgacgtaatg

SEQ ID NO: 84524 - DNA, 15 bp, Artificial Sequence
  dgRNA
  __NTC
agaacctcgacgacc

SEQ ID NO: 84525 - DNA, 15 bp, Artificial Sequence
  dgRNA
  __NTC
tcgtcaaggttcgat

SEQ ID NO: 84526 - DNA, 15 bp, Artificial Sequence
  dgRNA
  __NTC
taaacgaccagacga

SEQ ID NO: 84527 - DNA, 15 bp, Artificial Sequence
  dgRNA
  __NTC
tatcgtctcgtcaaa

SEQ ID NO: 84528 - DNA, 15 bp, Artificial Sequence
  dgRNA
  __NTC
aatggccgcgaaatc

SEQ ID NO: 84529 - DNA, 15 bp, Artificial Sequence
  dgRNA
  __NTC
acgagcgattggagg

SEQ ID NO: 84530 - DNA, 15 bp, Artificial Sequence
  dgRNA
  __NTC
cggacgagtgaacat

SEQ ID NO: 84531 - DNA, 15 bp, Artificial Sequence
  dgRNA
  __NTC
gcaacggtcggtggc

SEQ ID NO: 84532 - DNA, 15 bp, Artificial Sequence
  dgRNA
  __NTC
acgtcctcaccgggt

SEQ ID NO: 84533 - DNA, 15 bp, Artificial Sequence
  dgRNA
  __NTC
ttcacggccgagccg

SEQ ID NO: 84534 - DNA, 15 bp, Artificial Sequence
  dgRNA
  __NTC
cacgggttcgttact

SEQ ID NO: 84535 - DNA, 15 bp, Artificial Sequence
  dgRNA
  __NTC
cgggttactgagccg

SEQ ID NO: 84536 - DNA, 15 bp, Artificial Sequence
  dgRNA
  __NTC
cacgcaacgagcctc

SEQ ID NO: 84537 - DNA, 15 bp, Artificial Sequence
  dgRNA
  __NTC
ttgacgtgtaccgtt

SEQ ID NO: 84538 - DNA, 15 bp, Artificial Sequence
  dgRNA
  __NTC
tttgtctcgcaaccg

SEQ ID NO: 84539 - DNA, 15 bp, Artificial Sequence
  dgRNA
  __NTC
agactttcgccggcc

SEQ ID NO: 84540 - DNA, 15 bp, Artificial Sequence
  dgRNA
  __NTC
gaatgtgaccgatcg

SEQ ID NO: 84541 - DNA, 15 bp, Artificial Sequence
  dgRNA
  __NTC
attgggcgcacggca

SEQ ID NO: 84542 - DNA, 15 bp, Artificial Sequence
  dgRNA
  __NTC
agcgatggcccgcat

SEQ ID NO: 84543 - DNA, 15 bp, Artificial Sequence
  dgRNA
  __NTC
tcgtgacaagacgat

SEQ ID NO: 84544 - DNA, 15 bp, Artificial Sequence
  dgRNA
  __NTC
caccgcccgcactag

SEQ ID NO: 84545 - DNA, 15 bp, Artificial Sequence
  dgRNA
  __NTC
cggttagaacggatt

SEQ ID NO: 84546 - DNA, 15 bp, Artificial Sequence
  dgRNA
  __NTC
gacgcagcggctatt

SEQ ID NO: 84547 - DNA, 15 bp, Artificial Sequence
  dgRNA
  __NTC
ttcataccaacgtcg

SEQ ID NO: 84548 - DNA, 15 bp, Artificial Sequence
  dgRNA
  __NTC
cgaatgtcagatcga

SEQ ID NO: 84549 - DNA, 15 bp, Artificial Sequence
  dgRNA
  __NTC
tgcagtacgcgaaag

SEQ ID NO: 84550 - DNA, 15 bp, Artificial Sequence
  dgRNA
  __NTC
cgggcgccaattcct

SEQ ID NO: 84551 - DNA, 15 bp, Artificial Sequence
  dgRNA
  __NTC
tccgcacaccgcaac

SEQ ID NO: 84552 - DNA, 15 bp, Artificial Sequence
  dgRNA
  __NTC
gtatcacgcagcgca

SEQ ID NO: 84553 - DNA, 15 bp, Artificial Sequence
  dgRNA
  __NTC
agccgccctcgtact

SEQ ID NO: 84554 - DNA, 15 bp, Artificial Sequence
  dgRNA
  __NTC
ccgtatacaaatcga

SEQ ID NO: 84555 - DNA, 15 bp, Artificial Sequence
  dgRNA
  __NTC
cgggcaatttcgtct

SEQ ID NO: 84556 - DNA, 15 bp, Artificial Sequence
  dgRNA
  __NTC
atgaagttcgtaacg

SEQ ID NO: 84557 - DNA, 15 bp, Artificial Sequence
  dgRNA
  __NTC
ggccgaaccacgtct

SEQ ID NO: 84558 - DNA, 15 bp, Artificial Sequence
  dgRNA
  __NTC
gttcgccgtttggag

SEQ ID NO: 84559 - DNA, 15 bp, Artificial Sequence
  dgRNA
  __NTC
acgagggcacatcga

SEQ ID NO: 84560 - DNA, 15 bp, Artificial Sequence
  dgRNA
  __NTC
cggattcgccacaga

SEQ ID NO: 84561 - DNA, 15 bp, Artificial Sequence
  dgRNA
  __NTC
gacggccacgtctaa

SEQ ID NO: 84562 - DNA, 15 bp, Artificial Sequence
  dgRNA
  __NTC
agcaaccgcacgaat

SEQ ID NO: 84563 - DNA, 15 bp, Artificial Sequence
  dgRNA
  __NTC
tattaccggtacgtg

SEQ ID NO: 84564 - DNA, 15 bp, Artificial Sequence
  dgRNA
  __NTC
aacccgcacgcataa

SEQ ID NO: 84565 - DNA, 15 bp, Artificial Sequence
  dgRNA
  __NTC
accatcggaacgagt

SEQ ID NO: 84566 - DNA, 15 bp, Artificial Sequence
  dgRNA
  __NTC
gtcgttcggtagaag

SEQ ID NO: 84567 - DNA, 15 bp, Artificial Sequence
  dgRNA
  __NTC
acgcgcacctttgga

SEQ ID NO: 84568 - DNA, 15 bp, Artificial Sequence
  dgRNA
  __NTC
ctctacgatttccga

SEQ ID NO: 84569 - DNA, 15 bp, Artificial Sequence
  dgRNA
  __NTC
gggtgcgtcgagtgg

SEQ ID NO: 84570 - DNA, 15 bp, Artificial Sequence
  dgRNA
  __NTC
ggactttccgcacgt

SEQ ID NO: 84571 - DNA, 15 bp, Artificial Sequence
  dgRNA
  __NTC
tagtttcgtgcgatg

SEQ ID NO: 84572 - DNA, 15 bp, Artificial Sequence
  dgRNA
  __NTC
atcgccaaagccgta

SEQ ID NO: 84573 - DNA, 15 bp, Artificial Sequence
  dgRNA
  __NTC
cgccgtgcttaggac

SEQ ID NO: 84574 - DNA, 15 bp, Artificial Sequence
  dgRNA
  __NTC
cagtacgcggagagt

SEQ ID NO: 84575 - DNA, 15 bp, Artificial Sequence
  dgRNA
  __NTC
ggggagactcgccgt

SEQ ID NO: 84576 - DNA, 15 bp, Artificial Sequence
  dgRNA
  __NTC
tcgagctacataacg

SEQ ID NO: 84577 - DNA, 15 bp, Artificial Sequence
  dgRNA
  __NTC
ttggtcgcgcatccc

SEQ ID NO: 84578 - DNA, 15 bp, Artificial Sequence
  dgRNA
  __NTC
gcattcgcggttcag

SEQ ID NO: 84579 - DNA, 15 bp, Artificial Sequence
  dgRNA
  __NTC
cggctgtatccgagc

SEQ ID NO: 84580 - DNA, 15 bp, Artificial Sequence
  dgRNA
  __NTC
cccggttcaaacgaa

SEQ ID NO: 84581 - DNA, 15 bp, Artificial Sequence
  dgRNA
  __NTC
cgagagcaccggcgg

SEQ ID NO: 84582 - DNA, 15 bp, Artificial Sequence
  dgRNA
  __NTC
cgactctcgaaacta

SEQ ID NO: 84583 - DNA, 15 bp, Artificial Sequence
  dgRNA
  __NTC
ccgggaacggatcac

SEQ ID NO: 84584 - DNA, 15 bp, Artificial Sequence
  dgRNA
  __NTC
tgtaggcacgctcga

SEQ ID NO: 84585 - DNA, 15 bp, Artificial Sequence
  dgRNA
  __NTC
tacgttaagatgacg

SEQ ID NO: 84586 - DNA, 15 bp, Artificial Sequence
  dgRNA
  __NTC
gattggaacgatcga

SEQ ID NO: 84587 - DNA, 15 bp, Artificial Sequence
  dgRNA
  __NTC
agggttcgacggtgg

SEQ ID NO: 84588 - DNA, 15 bp, Artificial Sequence
  dgRNA
  __NTC
cgcggcctagggtca

SEQ ID NO: 84589 - DNA, 15 bp, Artificial Sequence
  dgRNA
  __NTC
ctagacgtttagcgt

SEQ ID NO: 84590 - DNA, 15 bp, Artificial Sequence
  dgRNA
  __NTC
tggcgcatacgaaat

SEQ ID NO: 84591 - DNA, 15 bp, Artificial Sequence
  dgRNA
  __NTC
gcgatgcgcattggt

SEQ ID NO: 84592 - DNA, 15 bp, Artificial Sequence
  dgRNA
  __NTC
cttaaggcggcgtgg

SEQ ID NO: 84593 - DNA, 15 bp, Artificial Sequence
  dgRNA
  __NTC
gcaaccacccggcgt

SEQ ID NO: 84594 - DNA, 15 bp, Artificial Sequence
  dgRNA
  __NTC
tttatgcgatgcgca

SEQ ID NO: 84595 - DNA, 15 bp, Artificial Sequence
  dgRNA
  __NTC
cgagacgaaatggtc

SEQ ID NO: 84596 - DNA, 15 bp, Artificial Sequence
  dgRNA
  __NTC
actcgccaccggtgg

SEQ ID NO: 84597 - DNA, 15 bp, Artificial Sequence
  dgRNA
  __NTC
gcgtccgctgaattc

SEQ ID NO: 84598 - DNA, 15 bp, Artificial Sequence
  dgRNA
  __NTC
tctaggccctccgcg

SEQ ID NO: 84599 - DNA, 15 bp, Artificial Sequence
  dgRNA
  __NTC
acgagtcgtacacaa

SEQ ID NO: 84600 - DNA, 15 bp, Artificial Sequence
  dgRNA
  __NTC
ggctatcgcgttcct

SEQ ID NO: 84601 - DNA, 15 bp, Artificial Sequence
  dgRNA
  __NTC
tacgttcgagaccac

SEQ ID NO: 84602 - DNA, 8255 bp, Artificial Sequence
  Vector
  TdgA
ttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccagagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggagacgggataccgtctctgttttagagctaggccaacatgaggatcacccatgtctgcagggcctagcaagttaaaataaggctagtccgttatcaacttggccaacatgaggatcacccatgtctgcagggccaagtggcaccgagtcggtgctttttttggatccaagcttggcgtaactagatcttgagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggcgccggctcgagggggcccggggaattcgctagctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggaccggttctagacgtacggccaccatgaacccagccatcagcgtcgctctcctgctctcagtcttgcaggtgtcccgagggcagaaggtgaccagcctgacagcctgcctggtgaaccaaaaccttcgcctggactgccgccatgagaataacaccaaggataactccatccagcatgagttcagcctgacccgagagaagaggaagcacgtgctctcaggcacccttgggatacccgagcacacgtaccgctcccgcgtcaccctctccaaccagccctatatcaaggtccttaccctagccaacttcaccaccaaggatgagggcgactacttttgtgagcttcgcgtgtcgggcgcgaatcccatgagctccaataaaagtatcagtgtgtatagagacaagctggtcaagtgtggcggcataagcctgctggttcagaacacatcctggatgctgctgctgctgctttccctctccctcctccaagccctggacttcatttctctgggcagtggagagggcagaggaagtctgctaacatgcggtgacgtcgaggagaatcctggcccaatggcttcaaactttactcagttcgtgctcgtggacaatggtgggacaggggatgtgacagtggctccttctaatttcgctaatggggtggcagagtggatcagctccaactcacggagccaggcctacaaggtgacatgcagcgtcaggcagtctagtgcccagaagagaaagtataccatcaaggtggaggtccccaaagtggctacccagacagtgggcggagtcgaactgcctgtcgccgcttggaggtcctacctgaacatggagctcactatcccaattttcgctaccaattctgactgtgaactcatcgtgaaggcaatgcaggggctcctcaaagacggtaatcctatcccttccgccatcgccgctaactcaggtatctacagcgctggaggaggtggaagcggaggaggaggaagcggaggaggaggtagcggacctaagaaaaagaggaaggtggcggccgctggatccccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggaggaggtggaagcggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctaatgtacaagcgctaataaaagatctttattttcattagatctgtgtgttggttttttgtgtggtaactctagacgtgcggtcgactttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtacgtatagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagc

SEQ ID NO: 84603 - DNA, 41 bp, Artificial Sequence
  Primer
  PCR1 Fwd
aatggactatcatatgcttaccgtaacttgaaagtatttcg

SEQ ID NO: 84604 - DNA, 45 bp, Artificial Sequence
  Primer
  PCR1 Rev
ctttagtttgtatgtctgttgctattatgtctactattctttccc

SEQ ID NO: 84605 - DNA, 4698 bp, Artificial Sequence
  Vector
  pLY57_TRAC-LHA-pAAV-EFS-CD22BBz-PRODH2-TRAC-RHA (3166mut)
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgttgtcctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggaccggttctagacgtacggccacctgcttctgctcgtgacaagcctgctgctgtgcgagctgccccaccctgcctttctgctgtccctcaggtgcagctgcagcagtctggccctggcctcgtgaagcctagccagaccctggcctgacctgtgccatcagcggcgatagcgtgtccagcaatagcgccgcctggaactggtcagacagagccctagcagaggcctggaatggctgggccggacctactaccggtccaagggtacaacgactacgccgtgtccgtgaagtcccggatcaccatcaaccccgacaccagcagaaccagttctccctgcagctgaacagcgtgacccccgaggataccgccgtgtactacgcgccagagaagtgaccggcgacctggaagatgccttcgacatctggggccagggcacatggtcaccgtgtctagcggaggcggcggaagcgacatccagatgacacagagccccagcccctgagcgccagcgtgggagacagagtgaccatcacctgtcgggccagccagaccatcggtcctacctgaactggtatcagcagcggcctggcaaggcccccaacctgctgatctatccgccagctcactgcagagcggcgtgcccagcagattttccggcagaggcagcggcaccacttcaccctgacaatcagttccctgcaggccgaggacttcgccacctactactgccagcagagctacagcatcccccagaccttcggccaggggaccaagctggaaatcaaagcggccgcaggtaccccacgacgccagcgccgcgaccaccaacaccggcgcccaccatcgcgtcgcagcccctgccctgcgcccagaggcatgccggccagcagcagggggcgcagtgcacacgagggggctgacttcgcctgtgatatctacatctgggcgcccttggccgggacttgtggggtccttctctgtcactggttatcaccctttactgcaaacggggcagaaagaaactcctgtatatattcaacaaccatttatgagaccagtacaaactactcaagaggaagatggctgtagctgccgattccagaagaagaagaaggaggatgtgaactgagagtgaagttcagcaggagcgcagaccccccgcgtaccagcagggccagaaccagctctataacgagctcaatctaggacgaagaaggagtacgatgttttggacaagagacgtggccgggaccctgagatggggggaaagccggaaggaagaaccctcaggaaggcctgtacaatgaactgcagaaagataagatggcggagcctacagtgagattgggatgaaaggcgagcgccggaggggcaaggggcacgatggccttaccagggtctcagtacagccaccaaggacacctacgacgcccttcacatgcaggccctgcccctcgcggcagtggagagggcagaggaagtctgctaacatgcggtgacgtcgaggagaatcctggcccaggtaccacggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 84606 - DNA, 4707 bp, Artificial Sequence
  Vector
  pLY59_TRAC-LHA-pAAV-EFS-CD22BBz-PRODH2(STOP)-TRAC-RHA(3166mut)
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgttgtcctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggaccggttctagacgtacggccacctgcttctgctcgtgacaagcctgctgctgtgcgagctgccccaccctgcctttctgctgtccctcaggtgcagctgcagcagtctggccctggcctcgtgaagcctagccagaccctggcctgacctgtgccatcagcggcgatagcgtgtccagcaatagcgccgcctggaactggtcagacagagccctagcagaggcctggaatggctgggccggacctactaccggtccaagggtacaacgactacgccgtgtccgtgaagtcccggatcaccatcaaccccgacaccagcagaaccagttctccctgcagctgaacagcgtgacccccgaggataccgccgtgtactacgcgccagagaagtgaccggcgacctggaagatgccttcgacatctggggccagggcacatggtcaccgtgtctagcggaggcggcggaagcgacatccagatgacacagagccccagcccctgagcgccagcgtgggagacagagtgaccatcacctgtcgggccagccagaccatcggtcctacctgaactggtatcagcagcggcctggcaaggcccccaacctgctgatctatccgccagctcactgcagagcggcgtgcccagcagattttccggcagaggcagcggcaccacttcaccctgacaatcagttccctgcaggccgaggacttcgccacctactactgccagcagagctacagcatcccccagaccttcggccaggggaccaagctggaaatcaaagcggccgcaggtaccccacgacgccagcgccgcgaccaccaacaccggcgcccaccatcgcgtcgcagcccctgccctgcgcccagaggcatgccggccagcagcagggggcgcagtgcacacgagggggctgacttcgcctgtgatatctacatctgggcgcccttggccgggacttgtggggtccttctctgtcactggttatcaccctttactgcaaacggggcagaaagaaactcctgtatatattcaacaaccatttatgagaccagtacaaactactcaagaggaagatggctgtagctgccgattccagaagaagaagaaggaggatgtgaactgagagtgaagttcagcaggagcgcagaccccccgcgtaccagcagggccagaaccagctctataacgagctcaatctaggacgaagaaggagtacgatgttttggacaagagacgtggccgggaccctgagatggggggaaagccggaaggaagaaccctcaggaaggcctgtacaatgaactgcagaaagataagatggcggagcctacagtgagattgggatgaaaggcgagcgccggaggggcaaggggcacgatggccttaccagggtctcagtacagccaccaaggacacctacgacgcccttcacatgcaggccctgcccctcgcggcagtggagagggcagaggaagtctgctaacatgcggtgacgtcgaggagaatcctggcccataatagtgaggtaccacggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 84607 - DNA, 4713 bp, Artificial Sequence
  Vector
  pLY58_TRAC-LHA-pAAV-EFS-CD22BBz-PRODH2(Mut)-TRAC-RHA(3166mut)
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgttgtcctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggaccggttctagacgtacggccacctgcttctgctcgtgacaagcctgctgctgtgcgagctgccccaccctgcctttctgctgtccctcaggtgcagctgcagcagtctggccctggcctcgtgaagcctagccagaccctggcctgacctgtgccatcagcggcgatagcgtgtccagcaatagcgccgcctggaactggtcagacagagccctagcagaggcctggaatggctgggccggacctactaccggtccaagggtacaacgactacgccgtgtccgtgaagtcccggatcaccatcaaccccgacaccagcagaaccagttctccctgcagctgaacagcgtgacccccgaggataccgccgtgtactacgcgccagagaagtgaccggcgacctggaagatgccttcgacatctggggccagggcacatggtcaccgtgtctagcggaggcggcggaagcgacatccagatgacacagagccccagcccctgagcgccagcgtgggagacagagtgaccatcacctgtcgggccagccagaccatcggtcctacctgaactggtatcagcagcggcctggcaaggcccccaacctgctgatctatccgccagctcactgcagagcggcgtgcccagcagattttccggcagaggcagcggcaccacttcaccctgacaatcagttccctgcaggccgaggacttcgccacctactactgccagcagagctacagcatcccccagaccttcggccaggggaccaagctggaaatcaaagcggccgcaggtaccccacgacgccagcgccgcgaccaccaacaccggcgcccaccatcgcgtcgcagcccctgccctgcgcccagaggcatgccggccagcagcagggggcgcagtgcacacgagggggctgacttcgcctgtgatatctacatctgggcgcccttggccgggacttgtggggtccttctctgtcactggttatcaccctttactgcaaacggggcagaaagaaactcctgtatatattcaacaaccatttatgagaccagtacaaactactcaagaggaagatggctgtagctgccgattccagaagaagaagaaggaggatgtgaactgagagtgaagttcagcaggagcgcagaccccccgcgtaccagcagggccagaaccagctctataacgagctcaatctaggacgaagaaggagtacgatgttttggacaagagacgtggccgggaccctgagatggggggaaagccggaaggaagaaccctcaggaaggcctgtacaatgaactgcagaaagataagatggcggagcctacagtgagattgggatgaaaggcgagcgccggaggggcaaggggcacgatggccttaccagggtctcagtacagccaccaaggacacctacgacgcccttcacatgcaggccctgcccctcgcggcagtggagagggcagaggaagtctgctaacatgcggtgacgtcgaggagaatcctggcccagctgctgccgctgccggtaccacggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 84608 - DNA, 5015 bp, Artificial Sequence
  Vector
  pLY55_TRAC-LHA-pAAV-U6LbcrTRAC-EFS-CD22BBz-PRODH2-TRAC-RHA(3166mut)
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgtgtcgcgttctagaagagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgaagcttggcgtaactagatcttgagacaaggtacctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggaccggttctagacgtacggccacctgcttctgctcgtgacaagcctgctgctgtgcgagctgccccaccctgcctttctgctgtccctcaggtgcagctgcagcagtctggccctggcctcgtgaagcctagccagaccctggcctgacctgtgccatcagcggcgatagcgtgtccagcaatagcgccgcctggaactggtcagacagagccctagcagaggcctggaatggctgggccggacctactaccggtccaagggtacaacgactacgccgtgtccgtgaagtcccggatcaccatcaaccccgacaccagcagaaccagttctccctgcagctgaacagcgtgacccccgaggataccgccgtgtactacgcgccagagaagtgaccggcgacctggaagatgccttcgacatctggggccagggcacatggtcaccgtgtctagcggaggcggcggaagcgacatccagatgacacagagccccagcccctgagcgccagcgtgggagacagagtgaccatcacctgtcgggccagccagaccatcggtcctacctgaactggtatcagcagcggcctggcaaggcccccaacctgctgatctatccgccagctcactgcagagcggcgtgcccagcagattttccggcagaggcagcggcaccacttcaccctgacaatcagttccctgcaggccgaggacttcgccacctactactgccagcagagctacagcatcccccagaccttcggccaggggaccaagctggaaatcaaagcggccgcaggtaccccacgacgccagcgccgcgaccaccaacaccggcgcccaccatcgcgtcgcagcccctgccctgcgcccagaggcatgccggccagcagcagggggcgcagtgcacacgagggggctgacttcgcctgtgatatctacatctgggcgcccttggccgggacttgtggggtccttctctgtcactggttatcaccctttactgcaaacggggcagaaagaaactcctgtatatattcaacaaccatttatgagaccagtacaaactactcaagaggaagatggctgtagctgccgattccagaagaagaagaaggaggatgtgaactgagagtgaagttcagcaggagcgcagaccccccgcgtaccagcagggccagaaccagctctataacgagctcaatctaggacgaagaaggagtacgatgttttggacaagagacgtggccgggaccctgagatggggggaaagccggaaggaagaaccctcaggaaggcctgtacaatgaactgcagaaagataagatggcggagcctacagtgagattgggatgaaaggcgagcgccggaggggcaaggggcacgatggccttaccagggtctcagtacagccaccaaggacacctacgacgcccttcacatgcaggccctgcccctcgcggcagtggagagggcagaggaagtctgctaacatgcggtgacgtcgaggagaatcctggcccagactacaaagaccatgacggtgattataaagatcatgacatcggtaccacggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 84609 - DNA, 4973 bp, Artificial Sequence
  Vector
  pLY56_TRAC-LHA-pAAV-U6LbcrTRAC-EFS-CD22BBz-GFP-TRAC-RHA(3166mut)
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgtgtcgcgttctagaagagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgaagcttggcgtaactagatcttgagacaaggtacctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggaccggttctagacgtacggccacctgcttctgctcgtgacaagcctgctgctgtgcgagctgccccaccctgcctttctgctgtccctcaggtgcagctgcagcagtctggccctggcctcgtgaagcctagccagaccctggcctgacctgtgccatcagcggcgatagcgtgtccagcaatagcgccgcctggaactggtcagacagagccctagcagaggcctggaatggctgggccggacctactaccggtccaagggtacaacgactacgccgtgtccgtgaagtcccggatcaccatcaaccccgacaccagcagaaccagttctccctgcagctgaacagcgtgacccccgaggataccgccgtgtactacgcgccagagaagtgaccggcgacctggaagatgccttcgacatctggggccagggcacatggtcaccgtgtctagcggaggcggcggaagcgacatccagatgacacagagccccagcccctgagcgccagcgtgggagacagagtgaccatcacctgtcgggccagccagaccatcggtcctacctgaactggtatcagcagcggcctggcaaggcccccaacctgctgatctatccgccagctcactgcagagcggcgtgcccagcagattttccggcagaggcagcggcaccacttcaccctgacaatcagttccctgcaggccgaggacttcgccacctactactgccagcagagctacagcatcccccagaccttcggccaggggaccaagctggaaatcaaagcggccgcaggtaccccacgacgccagcgccgcgaccaccaacaccggcgcccaccatcgcgtcgcagcccctgccctgcgcccagaggcatgccggccagcagcagggggcgcagtgcacacgagggggctgacttcgcctgtgatatctacatctgggcgcccttggccgggacttgtggggtccttctctgtcactggttatcaccctttactgcaaacggggcagaaagaaactcctgtatatattcaacaaccatttatgagaccagtacaaactactcaagaggaagatggctgtagctgccgattccagaagaagaagaaggaggatgtgaactgagagtgaagttcagcaggagcgcagaccccccgcgtaccagcagggccagaaccagctctataacgagctcaatctaggacgaagaaggagtacgatgttttggacaagagacgtggccgggaccctgagatggggggaaagccggaaggaagaaccctcaggaaggcctgtacaatgaactgcagaaagataagatggcggagcctacagtgagattgggatgaaaggcgagcgccggaggggcaaggggcacgatggccttaccagggtctcagtacagccaccaaggacacctacgacgcccttcacatgcaggccctgcccctcgcggcagtggagagggcagaggaagtctgctaacatgcggtgacgtcgaggagaatcctggcccaggtaccacggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 84610 - DNA, 10068 bp, Artificial Sequence
  Vector
  pLY040_FLAG_rat Ccnblip1
gtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagcgcgttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatcggcactgcgtgcgccaattctgcagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggttaattagctagctgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgacgtacggccaccatggattacaaagacgatgacgataagatgtctttgtgtgaagacatgttgctgtgcaattatcggaagtgtcgtatcaagctctctggctatgcttgggtcacggcctgctctcacatcttctgtgatcagcatggcagtggtgagttcagtcattcaccagcaatctgccctgcttgcaacagcaccctttctggaaagctagacattgtccggacagagctcagtccgtcagaggagtacaaagctatggtattggcagggcttcgacccgaggttgttttggacattagctcccgagcattggccttctggacgtaccaggtgcaccaggaacgtctctatcaagaatacaatttcagcaaggctgagaaccacttaaaacagatggagaagatatacacgcagcaaatacagagcaaggacgtagaattgacctctatgaaaggggaggttacctccatgaagaaagttctggaggaatacaagaagaagtttagtgatatctctgagaaactgatggagcgcaaccgccaataccaaaagctccaaggcctttatgatagcctcaggctaaggaatatcactatcgctagccaggagggctccctggaaccagctatgatcccacagtctggagtctttggcttcccatcagggaatagctcaaagttttctttggaccatacaccagctggaaatcaaggtggtggagatgaagatgttcagttcagaccattttttgtgtgttctcccacagcacctgaacctgttaacaacttctttagttttgcgtctcaaagccatgaagcagagcagcaagtctgcagcagggcctttaaagcaaaaagaatttaggaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgtcgacctcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaaggggggactggaagggctaattcactcccaacgaagacaagatatccttgatctgtggatctaccacacacaaggctacttccctgattggcagaactacacaccagggccagggatcagatatccactgacctttggatggtgctacaagctagtaccagttgagcaagagaaggtagaagaagccaatgaaggagagaacacccgcttgttacaccctgtgagcctgcatgggatggatgacccggagagagaagtattagagtggaggtttgacagccgcctagcatttcatcacatggcccgagagctgcatccggactgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgac

SEQ ID NO: 84611 - DNA, 10728 bp, Artificial Sequence
  Vector
  pLY040_FLAG_mWdr37
gtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagcgcgttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatcggcactgcgtgcgccaattctgcagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggttaattagctagctgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgacgtacggccaccatggattacaaagacgatgacgataagatgcccacagaaagcggaagttgttcaactgctcgccaagcaaaacaaaagcgcaagtctcatagcctttctatacgaagaactaacagctcagaacaagagaggactggactgccaagagaaatgttagaaggacaagattctaaactgccgtcctcagttcgcagtacactgctggaattgtttggccagatagaaagagaatttgaaaatctttacatcgaaaacttagaattgcgcagagaaattgatactcttaatgaacgtttagctggtgaaggacaagcgatcgatggggcagaattgagtaagggccaactcaaaacaaaagccagtcacagtaccagtcagctttctcagaagcttaagaccacctacaaggcttccaccagcaagattgtttccagctttaagattaccacatccagggccatctgtcagcttgtgaaggagtatattggccacagggatggcatctgggatgtcagtgttacaaggacacagcctattgttcttgggacagcatctgctgatcacacggctttgttgtggagcatagagactggcaaatgtcttgtcaagtacgctggccatgtgggctcagtaaattctataaaattccatccctcagagcagttggctcttactgcttctggagatcagactgctcatatctggagatacgtggtacagcttccaacacctcagcctgttgccgacactagtcaacaaatttctggtgaagatgaaatagaatgctctgataaagatgagcctgacattgatggagacgtgtccagtgactgtcctactgtccgagtcccactgacatctctcaaaagccaccagggtgtggttattgctgctgactggctggttggtgggaaacaagtggtgacagcctcatgggacagaactgccaacctgtatgatgtggagacatctgaactcgttcattccctgacagggcatgaccaggagttaacacattgttgcactcaccccacccagcggctcgtggtgacctcctcccgtgacacaactttccgtctctgggatttcagggacccttccatccactccgtgaatgttttccaaggacacacggacactgtgacctctgctgtgttcactgtgggagacaacgtcgtttcaggcagtgatgaccgcacagtaaaagtctgggatttaaaaaatatgagatctccaattgcgacaattcgtacagactctgccattaataggatcaatgtgtgtgttggccaaaaaatcatagccctcccccatgacaaccggcaagtgcgattgtttgatatgtcgggagtgaggctagcacggcttccccggagcagccgacagggtcacagacgaatggtgtgctgctcagcgtggagtgaagaccaccccatatgcaatctatttacctgtgggttcgataggcaagctattgggtggaacatcaatattcctgcactgttacaagaaaaataagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgtcgacctcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaaggggggactggaagggctaattcactcccaacgaagacaagatatccttgatctgtggatctaccacacacaaggctacttccctgattggcagaactacacaccagggccagggatcagatatccactgacctttggatggtgctacaagctagtaccagttgagcaagagaaggtagaagaagccaatgaaggagagaacacccgcttgttacaccctgtgagcctgcatgggatggatgacccggagagagaagtattagagtggaggtttgacagccgcctagcatttcatcacatggcccgagagctgcatccggactgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgac

SEQ ID NO: 84612 - DNA, 9699 bp, Artificial Sequence
  Vector
  pLY040_FLAG_mSreklip1
gtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagcgcgttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatcggcactgcgtgcgccaattctgcagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggttaattagctagctgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgacgtacggccaccatggattacaaagacgatgacgataagatggcagtcccaggttgcaacaaggacaatgtcagagcaggctgcagaaaatgtggctaccctggtcatctgactttcgagtgccgcaattttctccgggtagatcccaaaagggacattgtgttggacgtcagcagcaccagtagtgaggacagtgatgaagaaaatgaggagctgaacaagctgcaggctctgcaggagaaaagaataaatgaagaagaggaaaagaaaaaggaaaagagcagggagaaaattaaattgaagaaaaggaggaaaaggtcttactccagtgccactgaagaggactccgcaaaacaaaagaaacagaagtatcagaaaaaagaaaagaaaaaggaaaaaaagaacaagtcaaagaaaggaaagcatcacaaaaaggaaaaaaagaagagaaaaaaggaaaagcgttcttccccttaccattctgaactcaccaaaaagtaagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgtcgacctcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaaggggggactggaagggctaattcactcccaacgaagacaagatatccttgatctgtggatctaccacacacaaggctacttccctgattggcagaactacacaccagggccagggatcagatatccactgacctttggatggtgctacaagctagtaccagttgagcaagagaaggtagaagaagccaatgaaggagagaacacccgcttgttacaccctgtgagcctgcatgggatggatgacccggagagagaagtattagagtggaggtttgacagccgcctagcatttcatcacatggcccgagagctgcatccggactgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgac

SEQ ID NO: 84613 - DNA, 10608 bp, Artificial Sequence
  Vector
  pLY040_FLAG_mProhd2
gtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagcgcgttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatcggcactgcgtgcgccaattctgcagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggttaattagctagctgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgacgtacggccaccatggattacaaagacgatgacgataagatgatctggacgcgtctgccgctgtatggcccctccaagccctctacaggtggctggcagcccctgcgctttgatggtggggccttccatgtcaagggaaccgcagaactggcacgggctttgctagtgcttcgcctatgcgcctggccccctttggtcactcatggactagcgtttcaggcctggtctcagcgactcctgggatcccggctctcaggcgcacttcttcgagcatccatctacgggcagtttgtggccggggagacagcagaggaagtgaggaactgtgtcgggcagctgcaggccctgggactccagcccctgttggcagtacccaccgaggaggaaccagactccactgccaagaccagtgaggtctggtatgaggagaaccttagcgccatgctgcgctgtgtggacttatcccgagccctcgtggacgcccacggcccagccaggaacagcctcatgcagctgaaggtgaccgcgctagccagcactcggctttgtaaagagctgtcggcttggatccaaagacccagaggctcctcggagctgagccctgagaggctggcagaagccatggactcgggtcggaacctccagctctcctgcctcagcacagaacagaatcagcacctgcaggcctccctcagccgcttgcaccgagtggcacagcacgcccgggcgaagtgtgtgcggctgctggtagatgctgaatatactttcattaaccctgcactgtccctgctggtggctgccctggctgtgcgctggaacagccctgaggaaggtggtccgtgggtgtggaacacttaccaggcctatctaaaggacactcaccaacggctggagcaggacgccgaggcagcacacaaggctggcctggcatttggggtgaagttggtgcgaggtgcctatctggacaaggagagatccatgacacagctccaagggaaggaagactgtacccagcctgactatgaggccactagtcggagttacagccgctgtctagagctgatgctgcgctgcgtgtcgaaccacggtcccccgtgtcacctcatggtggcttcccacaatgaagaatccgttcgccaggcaactaagcgcatgtgggagctgggcattcctctggatgggcctgtctgttttggacaacttctgggcatgtgtgaccatgtctccctggcattagggcaggctggatatatggtgtacaagtctattccctatggctgcctggaggaggtgattccctacctgatccgaagagcccaggagaacaggagtgtgctgcagggtgcccgcagggagcaggcactactcagccaggaactgtggcggagactgctgggaaggacggcctaagaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgtcgacctcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaaggggggactggaagggctaattcactcccaacgaagacaagatatccttgatctgtggatctaccacacacaaggctacttccctgattggcagaactacacaccagggccagggatcagatatccactgacctttggatggtgctacaagctagtaccagttgagcaagagaaggtagaagaagccaatgaaggagagaacacccgcttgttacaccctgtgagcctgcatgggatggatgacccggagagagaagtattagagtggaggtttgacagccgcctagcatttcatcacatggcccgagagctgcatccggactgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgac

SEQ ID NO: 84614 - protein, 8 aa, Artificial Sequence
  Peptide
  Ovalbumin (257-264)
SIINFEKL

SEQ ID NO: 84615 - DNA, 100 bp, Artificial Sequence
  Primer
  SAM_BC_F01
aatgatacggcgaccaccgagatctacactctttccctacacgacgctcttccgatctaaaccggttgctttatatatcttgtggaaaggacgaaacacc

SEQ ID NO: 84616 - DNA, 101 bp, Artificial Sequence
  Primer
  SAM_BC_F02
aatgatacggcgaccaccgagatctacactctttccctacacgacgctcttccgatctcaggccaattgctttatatatcttgtggaaaggacgaaacacc

SEQ ID NO: 84617 - DNA, 102 bp, Artificial Sequence
  Primer
  SAM_BC_F03
aatgatacggcgaccaccgagatctacactctttccctacacgacgctcttccgatctgcattggaaccgctttatatatcttgtggaaaggacgaaacacc

SEQ ID NO: 84618 - DNA, 103 bp, Artificial Sequence
  Primer
  SAM_BC_F04
aatgatacggcgaccaccgagatctacactctttccctacacgacgctcttccgatcttgcaccttggaagctttatatatcttgtggaaaggacgaaacacc

SEQ ID NO: 84619 - DNA, 104 bp, Artificial Sequence
  Primer
  SAM_BC_F05
aatgatacggcgaccaccgagatctacactctttccctacacgacgctcttccgatctatgcaacacgtgtgctttatatatcttgtggaaaggacgaaacacc

SEQ ID NO: 84620 - DNA, 105 bp, Artificial Sequence
  Primer
  SAM_BC_F06
aatgatacggcgaccaccgagatctacactctttccctacacgacgctcttccgatctcatgcagcgcatatgctttatatatcttgtggaaaggacgaaacacc

SEQ ID NO: 84621 - DNA, 106 bp, Artificial Sequence
  Primer
  SAM_BC_F07
aatgatacggcgaccaccgagatctacactctttccctacacgacgctcttccgatctgcatgcatgtgacacgctttatatatcttgtggaaaggacgaaacacc

SEQ ID NO: 84622 - DNA, 106 bp, Artificial Sequence
  Primer
  SAM_BC_F08
aatgatacggcgaccaccgagatctacactctttccctacacgacgctcttccgatctagctgcactctgagagctttatatatcttgtggaaaggacgaaacacc

SEQ ID NO: 84623 - DNA, 100 bp, Artificial Sequence
  Primer
  SAM_BC_F09
aatgatacggcgaccaccgagatctacactctttccctacacgacgctcttccgatctaaggttccagctttatatatcttgtggaaaggacgaaacacc

SEQ ID NO: 84624 - DNA, 101 bp, Artificial Sequence
  Primer
  SAM_BC_F10
aatgatacggcgaccaccgagatctacactctttccctacacgacgctcttccgatctcagaattccggctttatatatcttgtggaaaggacgaaacacc

SEQ ID NO: 84625 - DNA, 102 bp, Artificial Sequence
  Primer
  SAM_BC_F11
aatgatacggcgaccaccgagatctacactctttccctacacgacgctcttccgatctgcataaccggtgctttatatatcttgtggaaaggacgaaacacc

SEQ ID NO: 84626 - DNA, 103 bp, Artificial Sequence
  Primer
  SAM_BC_F12
aatgatacggcgaccaccgagatctacactctttccctacacgacgctcttccgatcttgcacggaattcgctttatatatcttgtggaaaggacgaaacacc

SEQ ID NO: 84627 - DNA, 86 bp, Artificial Sequence
  Primer
  SAM_BC_NR01
caagcagaagacggcatacgagatatatcgcggtgactggagttcagacgtgtgctcttccgatctctcggtgccacttggccctg

SEQ ID NO: 84628 - DNA, 86 bp, Artificial Sequence
  Primer
  SAM_BC_NR02
caagcagaagacggcatacgagatgagatctcgtgactggagttcagacgtgtgctcttccgatctctcggtgccacttggccctg

SEQ ID NO: 84629 - DNA, 86 bp, Artificial Sequence
  Primer
  SAM_BC_NR03
caagcagaagacggcatacgagattgtgacacgtgactggagttcagacgtgtgctcttccgatctctcggtgccacttggccctg

SEQ ID NO: 84630 - DNA, 86 bp, Artificial Sequence
  Primer
  SAM_BC_NR04
caagcagaagacggcatacgagatctctagaggtgactggagttcagacgtgtgctcttccgatctctcggtgccacttggccctg

SEQ ID NO: 84631 - DNA, 15 bp, Artificial Sequence
  Primer
  Cutadapt 1
gttttagagctaggc

SEQ ID NO: 84632 - DNA, 16 bp, Artificial Sequence
  Primer
  Cutadapt 2
aaaggacgaaacaccg
